United States Patent
Chang et al.

(10) Patent No.: US 12,104,155 B2
(45) Date of Patent: Oct. 1, 2024

(54) UNC13A ANTISENSE OLIGONUCLEOTIDES

(71) Applicant: AcuraStem, Inc., Monrovia, CA (US)

(72) Inventors: Wen-Hsuan Chang, Monrovia, CA (US); Justin K. Ichida, Monrovia, CA (US)

(73) Assignee: ACURASTEM INCORPORATED, Pasadena, CA (US)

( * ) Notice: Subject to any disclaimer, the term of this patent is extended or adjusted under 35 U.S.C. 154(b) by 0 days.

(21) Appl. No.: 17/870,754

(22) Filed: Jul. 21, 2022

(65) Prior Publication Data

US 2023/0125137 A1    Apr. 27, 2023

Related U.S. Application Data

(60) Provisional application No. 63/203,409, filed on Jul. 21, 2021, provisional application No. 63/364,830, filed on May 17, 2022.

(51) Int. Cl.
  *C12N 15/113*   (2010.01)
  *A61P 25/28*    (2006.01)

(52) U.S. Cl.
  CPC ............ *C12N 15/113* (2013.01); *A61P 25/28* (2018.01); *C12N 2310/11* (2013.01); *C12N 2310/315* (2013.01); *C12N 2310/321* (2013.01)

(58) Field of Classification Search
  None
  See application file for complete search history.

(56) References Cited

U.S. PATENT DOCUMENTS

| | | |
|---|---|---|
| 2004/0241651 A1 | 12/2004 | Olek et al. |
| 2014/0142160 A1* | 5/2014 | Lee ............... C12N 15/113 435/375 |
| 2022/0033818 A1 | 2/2022 | Wang et al. |

FOREIGN PATENT DOCUMENTS

| | | | |
|---|---|---|---|
| WO | 2013173635 A1 | 11/2013 | |
| WO | 2013173637 A1 | 11/2013 | |
| WO | 2022018187 A1 | 1/2022 | |
| WO | 2022122872 A1 | 6/2022 | |
| WO | WO-2022216759 A1 * | 10/2022 | ........... C12N 15/113 |
| WO | WO-2022246251 A2 * | 11/2022 | ........... C12N 15/113 |
| WO | 2022246251 A3 | 12/2022 | |
| WO | 2023118087 A1 | 6/2023 | |

OTHER PUBLICATIONS

Brown, Anna-Leigh, et al., "TDP-43 loss and ALS-risk SNPs drive mis-splicing and depletion of UNC13A", Nature, 603:131-137, 2022.

Rosa Ma, X, et al., "TDP-43 Represses Cryptic Exon Inclusion in the FTD-ALS gene UNC13A", Nature, 603:124-130, 2022.

Rosa Ma, X, et al., "TDP-43 Represses Cryptic Exon Inclusion in the FTD-aLS gene UNC13A", https://doi.org/10.1101/2021.04.02.438213, bioRxiv, 42 pages, Apr. 4, 2021.

ISR and Written Opinion issued in PCT/US22/37888 on Nov. 17, 2022.

Brown, Anna-Leigh, et al., "Common ALS/FTD Risk Variants in UNC13A Exacerbate its Cryptic Splicing and Loss Upon TDP-43 Mislocalization", BIORVIX, Apr. 4, 2021, pp. 1-38 (XP055882478).

* cited by examiner

*Primary Examiner* — Brian Whiteman
*Assistant Examiner* — Stephanie L Sullivan
(74) *Attorney, Agent, or Firm* — Blank Rome LLP

(57) ABSTRACT

The present invention relates to UNC13A cryptic exon antisense oligonucleotides (ASOs), pharmaceutical compositions containing them, and methods for treating, inhibiting, suppressing, and preventing neurological diseases with them.

20 Claims, 11 Drawing Sheets

Specification includes a Sequence Listing.

UNC13A ANTISENSE OLIGONUCLEOTIDES

CROSS-REFERENCE TO RELATED APPLICATIONS

This application claims the benefit of U.S. Provisional Application No. 63/203,409, filed Jul. 21, 2021, and U.S. Provisional Application No. 63/364,830, filed May 17, 2022, each of which is hereby incorporated in its entirety by reference.

SEQUENCE LISTING

The instant application contains a Sequence Listing which has been submitted electronically in XML file format and is hereby incorporated by reference in its entirety. Said XML copy, created on Sep. 7, 2022, is named 151421-01703_SL.xml and is 8,115,605 bytes in size.

FIELD OF THE INVENTION

The present invention relates to UNC13A cryptic exon antisense oligonucleotides (ASOs), pharmaceutical compositions containing them, and methods for treating, inhibiting, suppressing, and preventing neurological or neurodegenerative diseases with them.

BACKGROUND OF THE INVENTION

Many neurodegenerative disorders in patients are difficult to effectively treat, especially where the pathology of a neurodegenerative disorder in a particular patient is not completely understood.

UNC13A belongs to a family of genes originally discovered in *C. elegans* and was named based on the uncoordinated (unc) movements exhibited by animals with mutations in these genes, owing to deficits in neurotransmitter release. UNC13A encodes a large multidomain protein expressed in the nervous system, where it localizes to neuromuscular junctions and plays an essential role in the vesicle priming step, prior to synaptic vesicle fusion. Variants within the UNC13A gene increase the risk of amyotrophic lateral sclerosis (ALS) and frontotemporal dementia (FTD), two related neurodegenerative diseases defined by mislocalization of the RNA-binding protein TDP-43. Rosa Ma et al., bioRxiv, Apr. 4, 2021.

Amyotrophic lateral sclerosis (ALS) and frontotemporal dementia (FTD) are complex diseases that result from many diverse genetic etiologies. Although therapeutic strategies that target specific causal mutations (e.g. C9ORF72 antisense oligonucleotides (ASOs)) may prove effective against individual forms of ALS or FTD, these approaches cannot address the vast majority of cases that have unknown genetic etiology. Moreover, given the large number of different genes that likely contribute to ALS and FTD and the fact that each genetic form is relatively rare, this strategy may be difficult to implement for all cases. Thus, there is a pressing need for new therapeutic strategies that rescue multiple forms of ALS and FTD, particularly those with unknown genetic etiologies.

A recent analysis of 205 patients from the Mayo Clinic bank who had FTD with TDP-43 pathology, stratified the cases on the basis of UNC13A genotype, and showed a dose-dependent decrease in survival time in individuals carrying UNC13A risk alleles (Rosa Ma et al., Nature, 603:124-130, 2022). Patients with two risk alleles had a median survival time 3 years less than those with the normal transcript. Similarly, variants of UNC13A increase the risk of ALS (Brown et al., Nature, 603:131-137, 2022). TDP-43 depletion induces robust inclusion of a cryptic exon in UNC13A, resulting in nonsense-mediated decay and loss of UNC13A protein (id.).

International Publication No. WO 2022/122872 describes particular antisense oligonucleotides which are said to be capable of modulating splicing by preventing inclusion of an UNC13A cryptic exon into an UNC13A mature mRNA.

There remains a need for effective treatments for many neurodegenerative disorders, such as amyotrophic lateral sclerosis (ALS).

SUMMARY OF THE INVENTION

The present invention relates to UNC13A cryptic exon antisense oligonucleotides (ASOs or UNC13A ASOs), pharmaceutical compositions containing them, and their use in the treatment of neurodegenerative disorders. In particular, the ASOs described herein are to a cryptic exon between canonical exons 20 and 21 of UNC13A, and result in exclusion of the cryptic exon in the UNC13A transcript and increased UNC13A protein expression.

One embodiment is a single stranded ASO that suppresses the expression of UNC13A, wherein the ASO has a nucleobase sequence that comprises at least 12 or 15 consecutive nucleobases of any of the nucleobase sequences of SEQ ID NOs: 1-1282. The ASO can also be any of SEQ ID Nos: 1-1282. In a preferred embodiment, the single stranded ASO has a nucleobase sequence that comprises at least 12 or 15 consecutive nucleobases of any of the nucleobase sequences of SEQ ID NOs: 4-6, 9-11, 22-25, 53, 55, 359, or 360. In another preferred embodiment, the single stranded ASO has a nucleobase sequence comprising the consecutive nucleobases of any of the nucleobase sequences of SEQ ID NOs: 4-6, 9-11, 22-25, 53, 55, 359, or 360. In yet another preferred embodiment, the ASO is any one of SEQ ID NOs: 645-647, 650-652, 663-666, 694, 696, 1000, and 1001.

Another embodiment is an oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 1-1282.

In certain embodiments, at least one internucleoside linkage in the ASO or oligonucleotide is a modified internucleoside linkage, and the modified internucleoside linkage may be a phosphorothioate internucleoside linkage or a phosphodiester internucleoside linkage. At least one of the nucleosides may also be a modified nucleobase.

In other embodiments, at least one nucleoside of the ASO may be a modified sugar moiety, where that modified sugar moiety can be a bicyclic sugar moiety, or the modified sugar moiety may comprise a 2'-O-methoxyethyl group. In certain aspects, the bicyclic sugar moiety comprises a 4'-CH(R)—O—2' bridge where the R group is, independently, H, $C_{1-12}$ alkyl, or a protecting group.

In a preferred embodiment, the ASO is a steric blocking ASO. The steric blocking ASO binds to the target RNA and sterically denies other molecules access for base pairing to the RNA. In one embodiment, each nucleoside in the ASO has a 2'-modified sugar moiety, such as a sugar moiety with a 2'-O-methoxyethyl group, and each internucleoside linkage is a phosphorothioate linkage.

In certain other embodiments, the nucleobase sequence of the oligonucleotide is at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% complementary to any one of SEQ ID NOs: 1-1282.

In other embodiments, the oligonucleotide consists of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 consecutive nucleobases of any of the nucleobase sequences of SEQ ID NOs: 1-1282.

In one embodiment, the ASO or oligonucleotide is 100% complementary to SEQ ID NO: 1207 (chr19:17641557-17642844).

Another embodiment is a pharmaceutical composition comprising an UNC13A ASO of the present invention and one or more pharmaceutically acceptable carriers, diluents, and/or excipients. In one embodiment, the pharmaceutical composition is suitable for parenteral administration, such as intracerebroventricular injection or intrathecal administration.

Yet another embodiment is a method of treating a subject having a neurological or neurodegenerative disease by administering to the subject a therapeutically effective amount of a UNC13A ASO or a pharmaceutical composition described herein. One embodiment is a method of treating amyotrophic lateral sclerosis (ALS) in a subject in need thereof by administering to the subject a therapeutically effective amount of a UNC13A ASO or a pharmaceutical composition described herein. Another embodiment is a method of treating frontotemporal dementia (FTD) in a subject in need thereof by administering to the subject a therapeutically effective amount of a UNC13A ASO or a pharmaceutical composition described herein.

Yet another embodiment is a method of treating a subject having an UNC13A disease or disorder by administering to the subject a therapeutically effective amount of an UNC13A ASO or a pharmaceutical composition described herein.

Yet another embodiment is a method of increasing UNC13A protein expression in a subject in need thereof by administering to the subject an effective amount of a UNC13A ASO or a pharmaceutical composition described herein.

In one embodiment of any of the methods described herein, the subject possesses a SNP variant associated with rs12973192 (C>G), rs12608932 (A>C), or both. Subjects having alleles with mutation on both SNPs may show a stronger response to treatment.

BRIEF DESCRIPTION OF THE FIGURES

A more complete appreciation of the invention and many of the attendant advantages thereof will be readily obtained as the same becomes better understood by reference to the following detailed description when considered in connection with the accompanying figures, wherein:

FIG. 4F discloses SEQ ID NOS: 604-607, 55, 637, and 639, respectively, in order of appearance.

DETAILED DESCRIPTION OF THE INVENTION

Figure 1:
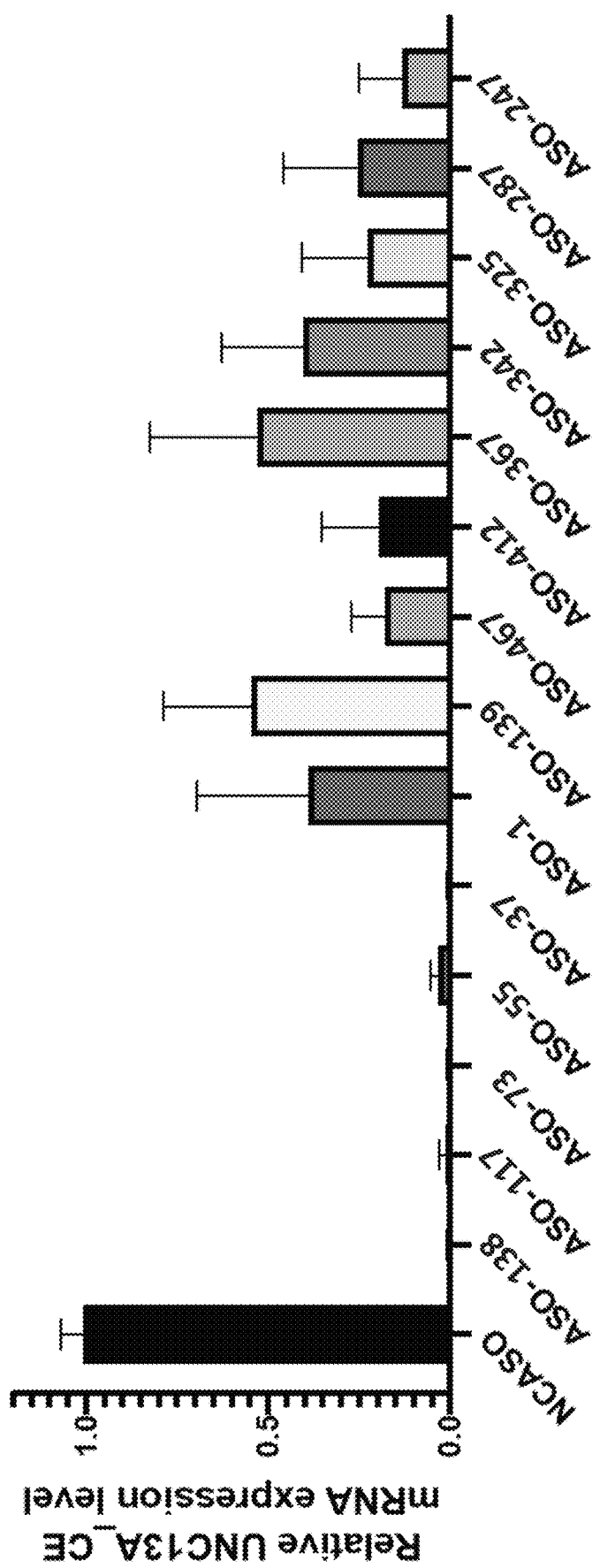
FIG. 1 is a chart showing mRNA levels of UNC13A cryptic exon (CE) after treatment with an ASO in a healthy control line with TDP-43 siRNA. For the screen, 14-day old Ngn2-induced neurons (Ngn2-iNs) were treated with TDP-43 siRNA (siTDP-43) for 7 days. qRT-PCR were performed with n=4 biological replicates. Mean +/−s.e.m. One-way ANOVA was used for statistical analysis. p-value *<0.05, <0.01, *<0.001,****<0.0001. "NCASO" refers to a negative control ASO.

Unless otherwise defined, all technical and scientific terms used herein have the same meaning as commonly understood by one of ordinary skill in the art. In case of conflict, the present document, including definitions, will control. Preferred methods and materials are described below, although methods and materials similar or equivalent to those described herein can be used in practice or testing of the present invention. All publications, patent applications, patents and other references mentioned herein are incorporated by reference in their entirety. The materials, methods, and examples disclosed herein are illustrative only and not intended to be limiting. The terminology used herein is for the purpose of describing particular embodiments only and is not intended to be limiting.

Definitions

The terms "comprise(s)," "include(s)," "having," "has," "can," "contain(s)," "may" and variants thereof, as used herein, are intended to be open-ended transitional phrases, terms, or words that do not preclude the possibility of additional acts or structures.

The singular forms "a," "an" and "the" include plural references unless the context clearly dictates otherwise.

The present disclosure also contemplates other embodiments "comprising," "consisting of" and "consisting essentially of," the embodiments or elements presented herein, whether explicitly set forth or not.

As used herein, "2'-deoxynucleoside" means a nucleoside comprising a 2'-H(H) furanosyl sugar moiety, as found in naturally occurring deoxyribonucleic acids (DNA) and a nucleobase. In certain embodiments, a 2'-deoxynucleoside may comprise a modified nucleobase and a furanosyl sugar moiety or may comprise an RNA nucleobase (uracil) furanosyl sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "antisense molecule" means an oligomeric nucleic acid or oligomeric duplex capable of achieving at least one antisense activity.

The modifier "about" used in connection with a quantity is inclusive of the stated value and has the meaning dictated by the context (for example, it includes at least the degree of error associated with the measurement of the particular quantity). The modifier "about" should also be considered as disclosing the range defined by the absolute values of the two endpoints. For example, the expression "from about 2 to about 4" also discloses the range "from 2 to 4." The term "about" may refer to plus or minus 10% of the indicated number. For example, "about 10%" may indicate a range of 9% to 11%, and "about 1" may mean from 0.9-1.1. Other meanings of "about" may be apparent from the context, such as rounding off, so, for example "about 1" may also mean from 0.5 to 1.4.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety. As used herein, "bicyclic nucleoside" or "BNA" means a nucleoside comprising a bicyclic sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T); adenine (A) and uracil (U); cytosine (C) and guanine (G); and 5-methylcytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

In certain embodiments, oligonucleotides comprise one or more type of modified sugar and/or unmodified sugar moiety arranged along the oligonucleotide or region thereof in a defined pattern or sugar motif. In certain instances, such sugar motifs include, but are not limited to, any of the sugar modifications discussed herein.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

"Inhibit" as used herein refers to the ability to substantially antagonize, prohibit, prevent, suppress, restrain, slow, disrupt, alter, eliminate, stop, or reverse the progression or severity of the activity of a particular agent (e.g., infectious agent) or disease.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate linkage" is a modified internucleoside linkage in which one of the non-bridging oxygen atoms of a phosphodiester internucleoside linkage is replaced with a sulfur atom.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include, but are not limited to, phosphates, which contain a phosphodiester bond (also referred to as unmodified or naturally occurring linkages), phosphotriesters, methylphosphonates or other alkylphosphonates, phosphoramidates, and phosphorothioates, and phosphorodithioates. Representative non-phosphorus containing internucleoside linking groups include but are not limited to methylenemethylimino ($-CH_2-N(CH_3)-O-CH_2-$), thiodiester, thionocarbamate ($-O-C(=O)(NH)-S-$); siloxane ($-SiH_2-O-$); and N,N'-dimethylhydrazine ($-CH_2-N(CH_3)-N(CH_3)-$). Modified internucleoside linkages, compared to naturally occurring phosphate linkages, can be used to alter, typically increase, nuclease resistance of the oligonucleotide. Methods of preparation of phosphorous-containing and non-phosphorous-containing internucleoside linkages are well known to those skilled in the art.

Representative internucleoside linkages having a chiral center include, but are not limited to, alkylphosphonates and phosphorothioates. Modified oligonucleotides comprising internucleoside linkages having a chiral center can be prepared as populations of modified oligonucleotides comprising stereo-random internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereo-random. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003); Wan et al., *Nuc. Acid. Res.* 42, 13456 (2014); Chapter 10 of Locked Nucleic Acid Aptamers in Nucleic Acid and Peptide Aptamers: Methods and Protocols v 535, 2009 by Barciszewski et al., editor Gunter Mayerand; and WO 2017/015555. In certain embodiments, a population of modified oligonucleotides is enriched for modified oligonucleotides having at least one indicated phosphorothioate in the (Sp) configuration. In another embodiment, a population of modified oligonucleotides is enriched for modified oligonucleotides having at least one indicated phosphorothioate in the (Rp) configuration.

As used herein, "MOE" means methoxyethyl. "2'-MOE" means a $-OCH_2CH_2OCH_3$ group at the 2' position of a furanosyl ring.

A "neurological disease" is any disease that causes electrical, biochemical, or structural abnormalities in the brain, spine, or neurons. For example, a neurological disease may be a neurodegenerative disease. The neurodegenerative disease may result in motor neuron degeneration, for example. The neurological disease may be amyotrophic lateral sclerosis (ALS), Huntington's disease, Alzheimer's disease, or frontotemporal dementia, for example. Further examples of neurological diseases include, but are not limited to, Parkinson's disease, chronic traumatic encephalopathy, multiple sclerosis, peripheral myopathy, Rasmussen's encephalitis, attention deficit hyperactivity disorder, autism, central pain syndromes, anxiety, and/or depression, for example. In one embodiment, the patient suffers from a neurological disease in which TDP-43 depletion occurs.

The neurological disease may be associated with aberrant endosomal trafficking. For example, endosomal pathways and endosomes are necessary components for the recycling or breakdown of membrane-bound proteins, trafficking of Golgi-associated proteins, and the extracellular release of proteins in exosomes. These processes aid neurotransmission and drive a balance between recycling and degradation of synaptic vesicles or neurotransmitter receptors, for example.

The neurological disease may be associated with aberrant lysosome degradation. Alterations in the lysosome degradation may be present in the neurological disease, such as a neurodegenerative disease. Cathepsin imbalance during aging and age-related diseases may provoke deleterious effects on central nervous system (CNS) neurons and lysosomes may be sites for the unfolding and partial degradation of membrane proteins or their precursors that subsequently become expelled from a cell, or are released from dead cells and accumulate as pathological entities.

A health care professional may diagnose a subject as having a disease associated with motor neuron degeneration by the assessment of one or more symptoms of motor neuron degeneration. To diagnose a neurological disease, a physical exam may be followed by a thorough neurological exam. The neurological exam may assess motor and sensory skills, nerve function, hearing and speech, vision, coordination and balance, mental status, and changes in mood or behavior. Non-limiting symptoms of a disease associated with a neurological disease may be weakness in the arms, legs, feet, or ankles; slurring of speech; difficulty lifting the front part of the foot and toes; hand weakness or clumsiness; muscle paralysis; rigid muscles; involuntary jerking or writing movements (chorea); involuntary, sustained contracture of muscles (dystonia); bradykinesia; loss of automatic movements; impaired posture and balance; lack of flexibility; tingling parts in the body; electric shock sensations that occur with movement of the head; twitching in arm, shoulders, and tongue; difficulty swallowing; difficulty breathing; difficulty chewing; partial or complete loss of vision; double vision; slow or abnormal eye movements; tremor; unsteady gait; fatigue; loss of memory; dizziness; difficulty thinking or concentrating; difficulty reading or writing; misinterpretation of spatial relationships; disorientation; depression; anxiety; difficulty making decisions and judgments; loss of impulse control; difficulty in planning and performing familiar tasks; aggressiveness; irritability; social withdrawal; mood swings; dementia; change in sleeping habits; wandering; and change in appetite.

Tests may be performed to rule diseases and disorders that may have symptoms similar to those of neurological diseases, measure muscle involvement, assess neuron degeneration. Non-limiting examples of tests are electromyography (EMG); nerve conduction velocity study; laboratory tests of blood, urine, or other substances; magnetic resonance imaging (MRI); magnetic resonance spectroscopy; muscle or nerve biopsy; transcranial magnetic stimulation; genetic screening; x-rays; fluoroscopy; angiography; computed tomography (CT); positron emission tomography; cerebrospinal fluid analysis; intrathecal contrast-enhanced CT scan; electroencephalography; electronystagmography; evoked response; polysomnogram; thermography; and ultrasound. A health care professional may also assess the patient's family history of diseases associated with motor neuron degeneration and make a diagnosis in part based on a familial history of neurological diseases. A healthcare professional may diagnose a disease associated with neurological disease in a subject after the presentation of one or more symptoms.

Neurodegenerative diseases result in the progressive destruction of neurons that affects neuronal signaling. For example, a neurodegeneration may be amyotrophic lateral sclerosis, Alzheimer's disease, Huntington's disease, Friedreich's ataxia, Lewy body disease, Parkinson's disease, spinal muscle atrophy, primary lateral sclerosis, progressive muscle atrophy, progressive bulbar palsy, and pseudobulbar palsy.

Diseases associated with motor neuron degeneration may be a condition that results in the progressive destruction of motor neurons that interferes with neuronal signaling to the muscles, leading to muscle weakness and wasting. In healthy individuals, upper motor neurons transmit signals from the brain to lower motor neurons in the brain stem and spinal cord, which then transmit the signal to the muscles to result in voluntary muscle activity. The destruction of upper and lower motor neurons affects activity such as breathing, talking, swallowing, and walking, and overtime these functions can be lost. Examples of motor neuron diseases include, but are not limited to, amyotrophic lateral sclerosis, primary lateral sclerosis, progressive muscle atrophy, progressive bulbar palsy, and pseudobulbar palsy.

Neuronal hyperexcitability may occur when receptors for the excitatory neurotransmitter glutamate (glutamate receptors) such as the NMDA receptor and AMPA receptor are over-activated by excess glutamate or by other compounds or neurotransmitters acting on the glutamate receptors. Excitotoxicity may result from neuronal hyperexcitability. Excitotoxicity is the pathological process by which nerve cells are damaged or killed by excessive stimulation. The excessive stimulation allows high levels of calcium ions ($Ca^{2+}$) to enter the cell. $Ca^{2+}$ influx into cells activates a number of enzymes, including phospholipases, endonucleases, and proteases such as calpain. These enzymes can damage cell structures such as components of the cytoskeleton, membrane, and DNA.

Neuronal hyperexcitability may be involved in spinal cord injury, stroke, traumatic brain injury, hearing loss (through noise overexposure or ototoxicity), epilepsy, painful neuropathies, attention deficit hyperactivity disorder, autism, central pain syndromes, neurodegenerative diseases, multiple sclerosis, Alzheimer's disease, amyotrophic lateral sclerosis (ALS), Parkinson's disease, frontotemporal dementia, schizophrenia, Rasmussen's encephalitis, Huntington's disease, alcoholism or alcohol withdrawal and especially over-rapid benzodiazepine withdrawal, and also Huntington's disease. Other common conditions that cause excessive glutamate concentrations around neurons are hypoglycemia. Blood sugars are the primary glutamate removal method from inter-synaptic spaces at the NMDA and AMPA receptor site.

As used herein, "non-bicyclic modified sugar moiety" means a modified sugar moiety that comprises a modification, such as a substituent, that does not form a bridge between two atoms of the sugar to form a second ring.

As used herein, "nucleobase" means an unmodified nucleobase or a modified nucleobase. As used herein, an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase or modified nucleobase. A "5-methylcytosine" or "mC" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethylcytosine, xanthine, hypoxanthine, 2-aminoadenine, 6-Nmethylguanine, 6-N-methyladenine, 2-propyladenine, 2-thiouracil, 2-thiothymine and 2-thiocytosine, 5-propynyl (—CC≡CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., Angewandte Chemie, International Edition, 1991, 30, 613; Sanghvi, Y. S., Chapter 15*Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a continuous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. The internucleoside linkages may be any described herein. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

"UNC13A," belongs to a family of genes originally discovered in C. elegans and was named based on the uncoordinated (unc) movements exhibited by animals with mutations in these genes, owing to deficits in neurotransmitter release. UNC13A encodes a large multidomain protein expressed in the nervous system, where it localizes to neuromuscular junctions and plays an essential role in the vesicle priming step, prior to synaptic vesicle fusion. Variants within the UNC13A gene have been known to increase risk of amyotrophic lateral sclerosis (ALS) and frontotemporal dementia (FTD), two related neurodegenerative diseases defined by mislocalization of the RNA-binding protein TDP-43.

As used herein, "sugar moiety" means an unmodified sugar moiety or a modified sugar moiety. The superscript prime symbol (') is used to describe the numbering of a sugar in a nucleoside or nucleotide (the nucleobase positions are numbered without the prime). When describing the sugar only, the prime symbol is not used. As used herein, "unmodified sugar moiety" means a 2-OH(H) furanosyl moiety, as found in RNA (an "unmodified RNA sugar moiety"), or a 2-H(H) moiety, as found in DNA (an "unmodified DNA sugar moiety"). Unmodified sugar moieties have one hydrogen at each of the 1, 3, and 4 positions, an oxygen at the 3 position, and two hydrogens at the 5 position. As used herein, "modified sugar moiety" or "modified sugar" means a modified furanosyl sugar moiety or a sugar surrogate. As used herein, modified furanosyl sugar moiety means a furanosyl sugar comprising a non-hydrogen substituent in place of at least one hydrogen of an unmodified sugar moiety. In certain embodiments, a modified furanosyl sugar moiety is a 2-substituted sugar moiety. Such modified furanosyl sugar moieties include bicyclic sugars and nonbicyclic sugars.

In certain embodiments, modified sugar moieties are nonbicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2, 4, and/or 5 positions. In certain embodiments one or more non-bridging substituent of non-bicyclic modified sugar moieties is branched. Examples of 2-substituent groups suitable for non-bicyclic modified sugar moieties include but are not limited to: 2-F, 2-OCH$_3$ ("OMe" or "O-methyl"), and 2-O(CH$_2$)$_2$OCH$_3$ ("MOE"). In certain embodiments, 2-substituent groups are selected from among: halo, allyl, amino, azido, SH, CN, OCN, CF$_3$, OCF$_3$, O—C$_{1-10}$ alkoxy, O—C$_{1-10}$ substituted alkoxy, O—C$_{1-10}$ alkyl, O—C$_{1-10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_{1-10}$ alkyl, and the 2-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), and alkyl. Examples of 5-substituent groups suitable for non-bicyclic modified sugar moieties include but are not limited to: 5-methyl (R or S), 5-vinyl, and 5-methoxy. In certain embodiments, non-bicyclic modified sugar moieties comprise more than one non-bridging sugar substituent, for example, 2-F-5-methyl sugar moieties and the like.

In certain embodiments, a 2'-substituted non-bicyclic modified nucleoside comprises a sugar moiety comprising a nonbridging 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)-N(R_m)(R_n)$), where each $R_m$ and $R_n$ is, independently, H, an amino protecting group, or substituted or unsubstituted $C_{1-10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)-N(H)CH_3$ ("NMA").

In certain embodiments, a 2'-substituted non-bicyclic modified nucleoside comprises a sugar moiety comprising a nonbridging 2'-substituent group selected from: F, $OCH_3$, and $OCH_2CH_2OCH_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4 and the 2 furanose ring atoms. Examples of such 4 to 2 bridging sugar substituents include but are not limited to: $4\text{-}CH_2\text{-}2$, $4\text{-}(CH_2)_2\text{-}2$, $4\text{-}(CH_2)_3\text{-}2$, $4\text{-}CH_2\text{-}O\text{-}2$ ("LNA"), $4\text{-}CH_2\text{-}S\text{-}2$, $4\text{-}(CH_2)2\text{-}O\text{-}2$ ("ENA"), $4\text{-}CH(CH_3)\text{-}O\text{-}2$ (referred to as "constrained ethyl" or "cEt"), $4\text{-}CH_2\text{-}O\text{-}CH_2\text{-}2$, $4\text{-}CH_2\text{-}N(R)\text{-}2$, $4\text{-}CH(CH_2OCH_3)\text{-}O\text{-}2$ ("constrained MOE" or "cMOE") and analogs thereof, $4\text{-}C(CH_3)(CH_3)\text{-}O\text{-}2$ and analogs thereof, $4\text{-}CH_2\text{-}N(OCH_3)\text{-}2$ and analogs thereof, $4\text{-}CH_2\text{-}O\text{-}N(CH_3)\text{-}2$, $4\text{-}CH_2\text{-}C(H)(CH_3)\text{-}2$, $4\text{-}CH2\text{-}C(=CH_2)\text{-}2$ and analogs thereof, $4\text{-}C(R_aR_b)\text{-}N(R)\text{-}O\text{-}2$, $4\text{-}C(R_aR_b)\text{-}O\text{-}N(R)\text{-}2$, $4\text{-}CH_2\text{-}O\text{-}N(R)\text{-}2$, and $4\text{-}CH_2\text{-}N(R)\text{-}O\text{-}2$, wherein each R, $R_a$, and $R_b$, is, independently, H, a protecting group, or $C_{1-12}$ alkyl.

In certain embodiments, such 4 to 2 bridges independently comprise from 1 to 4 linked groups independently selected from: $-[C(R_a)(R_b)]_n-$, $-[C(R_a)(R_b)]_n-O-$, $-C(R_a)=C(R_b)-$, $-C(R_a)=N-$, $-C(=NR_a)-$, $-C(=O)-$, $-C(=S)-$, $-O-$, $-Si(R_a)_2-$, $-S(=O)_x-$, and $-N(R_a)-$; wherein: x is 0, 1, or 2; n is 1, 2, 3, or 4; each $R_a$ and $R_b$ is, independently, H, a protecting group, hydroxyl, $C_{1-12}$ alkyl, substituted $C_{1-12}$ alkyl, $C_{1-12}$ alkenyl, substituted $C_{2-12}$ alkenyl, $C_{2-12}$ alkynyl, substituted $C_{2-12}$ alkynyl, $C_{5-20}$ aryl, substituted $C_{5-20}$ aryl, heterocycle radical, substituted heterocycle radical, heteroaryl, substituted heteroaryl, $C_{5-7}$ alicyclic radical, substituted C5-7 alicyclic radical, halogen, $OJ_1$, $NJ_1J_2$, $SJ_1$, $N_3$, $COOJ_1$, acyl ($C(=O)-H$), substituted acyl, CN, sulfonyl ($S(=O)_2-J_1$), or sulfoxyl ($S(=O)-J_1$); and each $J_1$ and $J_2$ is, independently, H, $C_{1-12}$ alkyl, substituted $C_{1-12}$ alkyl, $C_{2-12}$ alkenyl, substituted $C_{2-12}$ alkenyl, $C_{2-12}$ alkynyl, substituted $C_{2-12}$ alkynyl, $C_{5-20}$ aryl, substituted $C_{5-20}$ aryl, acyl ($C(=O)-H$), substituted acyl, a heterocycle radical, a substituted heterocycle radical, $C_{1-12}$ aminoalkyl, substituted $C_{1-12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

"Subject" and "patient" as used herein interchangeably refers to any vertebrate, including, but not limited to, a mammal (e.g., cow, pig, camel, llama, horse, goat, rabbit, sheep, hamsters, guinea pig, cat, dog, rat, and mouse, a non-human primate (for example, a monkey, such as a cynomolgous or rhesus monkey, chimpanzee, etc.) and a human). In some embodiments, the subject may be a human or a non-human. In a preferred embodiment, the subject or patient is a human. The subject or patient may be undergoing other forms of treatment.

A "therapeutically effective amount," or "effective dosage" or "effective amount" as used interchangeably herein unless otherwise defined, means a dosage of a drug effective for periods of time necessary, to achieve the desired therapeutic result. An effective dosage may be determined by a person skilled in the art and may vary according to factors such as the disease state, age, sex, and weight of the individual, and the ability of the drug to elicit a desired response in the individual. This term as used herein may also refer to an amount effective at bringing about a desired in vivo effect in an animal, mammal, or human. A therapeutically effective amount may be administered in one or more administrations (e.g., the agent may be given as a preventative treatment or therapeutically at any stage of disease progression, before or after symptoms, and the like), applications or dosages and is not intended to be limited to a particular formulation, combination or administration route. It is within the scope of the present disclosure that the drug may be administered at various times during the course of treatment of the subject. The times of administration and dosages used will depend on several factors, such as the goal of treatment (e.g., treating v. preventing), condition of the subject, etc. and can be readily determined by one skilled in the art.

As used herein, the term "treat" or "treating" a subject, refers to administering a composition or agent described herein to the subject, such that at least one symptom of a disease or disorder is healed, alleviated, relieved, altered, remedied, reduced, ameliorated, or improved. Treating includes administering an amount effective to alleviate, relieve, alter, remedy, reduce, ameliorate, and/or improve one or more symptoms associated with a disease or disorder. The treatment may inhibit deterioration or worsening of a symptom associated with the disease or disorder.

A hallmark pathological feature of amyotrophic lateral sclerosis (ALS) and frontotemporal dementia (FTD) is the depletion of RNA-binding protein TDP-43 from the nucleus of neurons in the brain and spinal cord to the cytoplasm where it aggregates into insoluble inclusion bodies in more than 95% of ALS cases and about 45% of FTD cases postmortem (Brown, supra). A major function of TDP-43 is as a repressor of cryptic exon (between canonical exons 20 and 21) inclusion during RNA splicing. Single nucleotide polymorphisms (SNPs) in UNC13A are among the strongest genome-wide association study (GWAS) hits associated with FTD/ALS in humans (Diekstra et al., Ann. Neurol. 76, 120-133, 2014). Evidence has shown that TDP-43 represses a cryptic exon splicing event in UNC13A. (Unlike normal conserved exons, these cryptic exons lurk in introns and are normally excluded from mature mRNAs.) Loss of TDP-43 from the nucleus in the human brain, neuronal cell lines, and iPSC-derived motor neurons resulted in the inclusion of the cryptic exon in UNC13A mRNA and reduced UNC13A protein expression. Rosa Ma et al., "TDP-43 represses cryptic exon inclusion in FTD/ALS gene UNC13A.", https://doi.org/10.1101/2021.04.02.438213, bioRxiv (posted Apr. 4, 2021). The top variants associated with FTD/ALS risk in humans are located in the cryptic exon harboring intron itself and it is shown that they increase UNC13A cryptic exon splicing in the face of TDP-43 dysfunction. Data shows that there is a direct functional link between one of the strongest genetic risk factors for FTD/ALS (UNC13A genetic variants) and loss of TDP-43 function.

According to Rosa Ma, the most significant genetic variants associated with FTD/ALS disease risk are located within the intron harboring the cryptic exon itself. Brain samples from Frontotemporal lobar degeneration (FTLD) with TDP-43 inclusions (FTLD-TDP) patients carrying these SNPs exhibited more UNC13A cryptic exon inclusion than those from FTLD-TDP patients lacking the risk alleles. These risk alleles, according to Rosa Ma, are insufficient to cause cryptic exon inclusion because the cryptic exon is not detected in RNA sequence data from healthy control samples (GTEx) and functional studies indicate that TDP-43 dysfunction is required for UNC13A cryptic exon inclusion. Instead, the UNC13A risk alleles exert a TDP-43 loss-of-function-dependent disease modifying effect. Without being bound by any particular theory, the inventors theorize that increase of UNC13A protein expression is an effective treatment for neurodegenerative diseases, such as ALS and FTD.

The cryptic exon occurs in two forms distinguishable by their size, between exons 20 and 21 after TDP-43 knockdown. One risk SNP, rs12973192, lies 16 base pairs inside the cryptic exon, and another is located 534 base pairs downstream of the donor splice site of the cryptic exon within the same intron. The risk SNPs increase the amount of cryptic exon inclusion in cortex from ALS and FTD cases in an independent and additive fashion. A recent analysis of UNC13A CE inclusion in bulk RNA-seq data from brain and spinal cord tissues of 377 individuals including ALS, FTD and controls, showed that the UNC13A CE was detected in post-mortem tissues from ALS or FTD patients with TDP-43 pathology (Brown et al., Nature 603:131-137, 2022), and not UNC13A risk SNP carriers. Cryptic exon expression mirrored the known tissue distribution of TDP-43 aggregation and clearance: it was specific to ALS spinal cord and motor cortex as well as FTD frontal and temporal cortices, but was absent from the cerebellum in both disease and control.

The herein described methods of treatment comprises administering to a subject in need thereof a composition comprising an effective amount of one or more antisense oligonucleotides that treats neurological diseases by suppressing, preventing, or inhibiting transcription of the cryptic exon of UNC13A. The one or more antisense oligonucleotides may decrease or inhibit neurodegeneration.

Restoring UNC13A levels in ALS patients who have TDP-43 pathology may result in extending survival in patients with neurological and neurodegenerative diseases, such as ALS or FTD, for instance by several years. The presently claimed antisense oligonucleotides (ASOs) can be injected directly into the spinal cord and achieve sustained target engagement throughout the central nervous system with minimal peripheral toxicity.

The disclosure provides oligonucleotides (modified or unmodified) that can be used to modulate UNC13A expression. Table 1 provides (5' to 3') generic sequence of bases for the human UNC13A antisense oligonucleotides or inhibitory nucleic acids of the disclosure.

Figure 2:
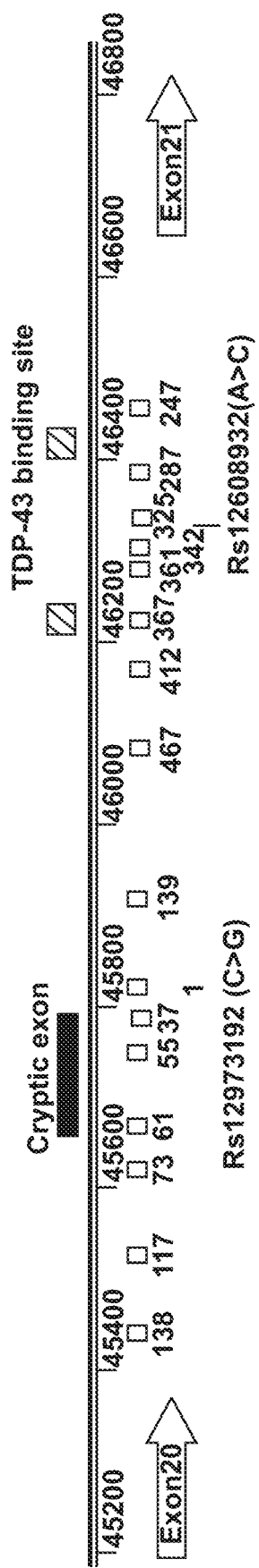
FIG. 2 shows the locations of the ASOs with respect to the cryptic exon, TDP-43 binding site, and relative to the SNPs, rs12608932 and rs12973192.

UNC13A risk haplotype associated with ALS/FTD susceptibility potentiates cryptic exon inclusion when TDP-43 is dysfunctional. SNPs associated with ALS/FTD in UNC13A include rs12608932 and rs12973192. rs12608932 (A>C) and rs12973192 (C>G), are both located in the same intron that was found to harbor the cryptic exon. FIG. 2 shows the locations of the ASOs with respect to the cryptic exon, TDP-43 binding site, and relative to the SNPs, rs12608932 and rs12973192.

TABLE 1

| SEQ ID NO. | Sequence |
| --- | --- |
| 1 | GAATCTACCCACCAACTCAT |
| 2 | AATCTACCCACCAACTCATC |
| 3 | ATCTACCCACCAACTCATCC |
| 4 | TCTACCCACCAACTCATCCA |
| 5 | CTACCCACCAACTCATCCAT |
| 6 | TACCCACCAACTCATCCATC |
| 7 | ACCCACCAACTCATCCATCT |
| 8 | CCCACCAACTCATCCATCTA |
| 9 | CCACCAACTCATCCATCTAT |
| 10 | CACCAACTCATCCATCTATC |
| 11 | ACCAACTCATCCATCTATCC |
| 12 | CCAACTCATCCATCTATCCA |
| 13 | CAACTCATCCATCTATCCAT |
| 14 | AACTCATCCATCTATCCATC |
| 15 | ACTCATCCATCTATCCATCC |
| 16 | CTCATCCATCTATCCATCCA |
| 17 | TCATCCATCTATCCATCCAT |
| 18 | CATCCATCTATCCATCCATG |
| 19 | ATCCATCTATCCATCCATGT |
| 20 | TCCATCTATCCATCCATGTA |
| 21 | CCATCTATCCATCCATGTAC |
| 22 | CATCTATCCATCCATGTACT |

TABLE 1-continued

| SEQ ID NO. | Sequence |
|---|---|
| 23 | ATCTATCCATCCATGTACTC |
| 24 | TCTATCCATCCATGTACTCA |
| 25 | CTATCCATCCATGTACTCAC |
| 26 | TATCCATCCATGTACTCACC |
| 27 | ATCCATCCATGTACTCACCC |
| 28 | TCCATCCATGTACTCACCCA |
| 29 | CCATCCATGTACTCACCCAT |
| 30 | CATCCATGTACTCACCCATC |
| 31 | ATCCATGTACTCACCCATCT |
| 32 | TCCATGTACTCACCCATCTC |
| 33 | CCATGTACTCACCCATCTCT |
| 34 | CATGTACTCACCCATCTCTC |
| 35 | ATGTACTCACCCATCTCTCC |
| 36 | TGTACTCACCCATCTCTCCA |
| 37 | GTACTCACCCATCTCTCCAT |
| 38 | TACTCACCCATCTCTCCATC |
| 39 | ACTCACCCATCTCTCCATCC |
| 40 | CTCACCCATCTCTCCATCCA |
| 41 | TCACCCATCTCTCCATCCAT |
| 42 | CACCCATCTCTCCATCCATC |
| 43 | ACCCATCTCTCCATCCATCC |
| 44 | CCCATCTCTCCATCCATCCT |
| 45 | CCATCTCTCCATCCATCCTT |
| 46 | CATCTCTCCATCCATCCTTT |
| 47 | ATCTCTCCATCCATCCTTTT |
| 48 | TCTCTCCATCCATCCTTTTA |
| 49 | CTCTCCATCCATCCTTTTAT |
| 50 | TCTCCATCCATCCTTTTATC |
| 51 | CTCCATCCATCCTTTTATCT |
| 52 | CCATCCATCCTTTTATCTAC |
| 53 | CTACTCATCACTCATTCATC |
| 54 | ACTCATCACTCATTCATCTG |
| 55 | CTCATCACTCATTCATCTGT |
| 56 | CATCACTCATTCATCTGTTC |
| 57 | TCATTCATTCATTCACCAGC |
| 58 | CATTCATTCATTCACCAGCA |
| 59 | GGATAAGAGTTCTTTCCAGG |
| 60 | GATAAGAGTTCTTTCCAGGA |
| 61 | TTCCAGGAAACCCAGGCAGC |

TABLE 1-continued

| SEQ ID NO. | Sequence |
|---|---|
| 62 | TCCAGGAAACCCAGGCAGCT |
| 63 | AGCTGGAAGAGACATACCCA |
| 64 | GCTGGAAGAGACATACCCAG |
| 65 | CTGGAAGAGACATACCCAGA |
| 66 | TGGAAGAGACATACCCAGAC |
| 67 | GGAAGAGACATACCCAGACA |
| 68 | GAAGAGACATACCCAGACAC |
| 69 | AAGAGACATACCCAGACACA |
| 70 | AGAGACATACCCAGACACAA |
| 71 | GAGACATACCCAGACACAAA |
| 72 | AGACATACCCAGACACAAAC |
| 73 | GCCCAATCCTGAGTGGTTAG |
| 74 | CCCAATCCTGAGTGGTTAGG |
| 75 | GGCTGGAATAGAAGGAAGAA |
| 76 | GCTGGAATAGAAGGAAGAAC |
| 77 | CTGGAATAGAAGGAAGAACC |
| 78 | TGGAATAGAAGGAAGAACCT |
| 79 | GGAATAGAAGGAAGAACCTG |
| 80 | GAATAGAAGGAAGAACCTGA |
| 81 | ATAGAAGGAAGAACCTGATG |
| 82 | TAGAAGGAAGAACCTGATGA |
| 83 | AGAAGGAAGAACCTGATGAT |
| 84 | GAAGGAAGAACCTGATGATG |
| 85 | AAGGAAGAACCTGATGATGA |
| 86 | AGGAAGAACCTGATGATGAG |
| 87 | GGAAGAACCTGATGATGAGT |
| 88 | GAAGAACCTGATGATGAGTA |
| 89 | AAGAACCTGATGATGAGTAG |
| 90 | AGAACCTGATGATGAGTAGT |
| 91 | GAACCTGATGATGAGTAGTG |
| 92 | AACCTGATGATGAGTAGTGA |
| 93 | ACCTGATGATGAGTAGTGAG |
| 94 | CCTGATGATGAGTAGTGAGA |
| 95 | CTGATGATGAGTAGTGAGAG |
| 96 | TGATGATGAGTAGTGAGAGT |
| 97 | GATGATGAGTAGTGAGAGTC |
| 98 | ATGATGAGTAGTGAGAGTCA |
| 99 | TGATGAGTAGTGAGAGTCAA |
| 100 | GATGAGTAGTGAGAGTCAAC |

TABLE 1-continued

| SEQ ID NO. | Sequence |
| --- | --- |
| 101 | ATGAGTAGTGAGAGTCAACC |
| 102 | TGAGTAGTGAGAGTCAACCT |
| 103 | GAGTAGTGAGAGTCAACCTG |
| 104 | AGTAGTGAGAGTCAACCTGG |
| 105 | GTAGTGAGAGTCAACCTGGA |
| 106 | TAGTGAGAGTCAACCTGGAG |
| 107 | AGTGAGAGTCAACCTGGAGG |
| 108 | GTGAGAGTCAACCTGGAGGC |
| 109 | TTCCCAGAGGAGGTGACCCT |
| 110 | CCAGAGGAGGTGACCCTGAA |
| 111 | CAGAGGAGGTGACCCTGAAT |
| 112 | AGAGGAGGTGACCCTGAATC |
| 113 | GAGGAGGTGACCCTGAATCT |
| 114 | AGGAGGTGACCCTGAATCTG |
| 115 | GGAGGTGACCCTGAATCTGG |
| 116 | GAGGTGACCCTGAATCTGGA |
| 117 | AGGTGACCCTGAATCTGGAC |
| 118 | GGTGACCCTGAATCTGGACT |
| 119 | GTGACCCTGAATCTGGACTT |
| 120 | TGACCCTGAATCTGGACTTT |
| 121 | GACCCTGAATCTGGACTTTG |
| 122 | ACCCTGAATCTGGACTTTGA |
| 123 | CCCTGAATCTGGACTTTGAT |
| 124 | CCTGAATCTGGACTTTGATG |
| 125 | CTGAATCTGGACTTTGATGG |
| 126 | TGAATCTGGACTTTGATGGA |
| 127 | GAATCTGGACTTTGATGGAT |
| 128 | ATCTGGACTTTGATGGATAG |
| 129 | TCTGGACTTTGATGGATAGG |
| 130 | GGAGGAGTTTTCCAGGTAAA |
| 131 | GAGGAGTTTTCCAGGTAAAG |
| 132 | AGGAGTTTTCCAGGTAAAGG |
| 133 | GCCAGGAGAGTGTGGATGGT |
| 134 | CCAGGAGAGTGTGGATGGTG |
| 135 | CAGGAGAGTGTGGATGGTGT |
| 136 | AGGAGAGTGTGGATGGTGTG |
| 137 | GGAGAGTGTGGATGGTGTGG |
| 138 | GAGAGTGTGGATGGTGTGGC |
| 139 | AATTACCCCCAAATTCACCC |
| 140 | ATTACCCCCAAATTCACCCA |
| 141 | TTACCCCCAAATTCACCCAT |
| 142 | TACCCCCAAATTCACCCATC |
| 143 | ACCCCCAAATTCACCCATCC |
| 144 | CCCCCAAATTCACCCATCCA |
| 145 | CCCCAAATTCACCCATCCAT |
| 146 | CCCAAATTCACCCATCCATA |
| 147 | CCAAATTCACCCATCCATAC |
| 148 | CAAATTCACCCATCCATACA |
| 149 | AATTCACCCATCCATACATC |
| 150 | ATTCACCCATCCATACATCT |
| 151 | TTCACCCATCCATACATCTA |
| 152 | TCACCCATCCATACATCTAT |
| 153 | CACCCATCCATACATCTATA |
| 154 | ACCCATCCATACATCTATAC |
| 155 | CCCATCCATACATCTATACT |
| 156 | CATATATCCATCCATCTGTC |
| 157 | ATATATCCATCCATCTGTCC |
| 158 | TATATCCATCCATCTGTCCA |
| 159 | ATATCCATCCATCTGTCCAT |
| 160 | TATCCATCCATCTGTCCATC |
| 161 | ATCCATCCATCTGTCCATCC |
| 162 | TCCATCCATCTGTCCATCCA |
| 163 | CCATCCATCTGTCCATCCAT |
| 164 | CATCCATCTGTCCATCCATC |
| 165 | ATCCATCTGTCCATCCATCC |
| 166 | TCCATCTGTCCATCCATCCA |
| 167 | CCATCTGTCCATCCATCCAT |
| 168 | CATCTGTCCATCCATCCATC |
| 169 | ATCTGTCCATCCATCCATCA |
| 170 | TCTGTCCATCCATCCATCAT |
| 171 | CTGTCCATCCATCCATCATC |
| 172 | TGTCCATCCATCCATCATCC |
| 173 | GTCCATCCATCCATCATCCA |
| 174 | TCCATCCATCCATCATCCAT |
| 175 | CCATCCATCCATCATCCATC |
| 176 | CATCCATCCATCATCCATCT |
| 177 | ATCCATCCATCATCCATCTA |
| 178 | TCCATCCATCATCCATCTAG |

TABLE 1-continued

| SEQ ID NO. | Sequence |
|---|---|
| 179 | CCATCCATCATCCATCTAGC |
| 180 | CATCCATCATCCATCTAGCC |
| 181 | ATCCATCATCCATCTAGCCA |
| 182 | TCCATCATCCATCTAGCCAC |
| 183 | GGAGAGAAAGTGTCATGGAG |
| 184 | GAGAGAAAGTGTCATGGAGA |
| 185 | AGAGAAAGTGTCATGGAGAG |
| 186 | GAGAAAGTGTCATGGAGAGT |
| 187 | AGAAAGTGTCATGGAGAGTG |
| 188 | GAAAGTGTCATGGAGAGTGC |
| 189 | GGCAGCTTACATCATCCATC |
| 190 | GCAGCTTACATCATCCATCT |
| 191 | CAGCTTACATCATCCATCTG |
| 192 | AGCTTACATCATCCATCTGC |
| 193 | GCTTACATCATCCATCTGCC |
| 194 | CTTACATCATCCATCTGCCT |
| 195 | TTACATCATCCATCTGCCTG |
| 196 | TACATCATCCATCTGCCTGT |
| 197 | ACATCATCCATCTGCCTGTT |
| 198 | CATCATCCATCTGCCTGTTT |
| 199 | ATCATCCATCTGCCTGTTTA |
| 200 | TCATCCATCTGCCTGTTTAT |
| 201 | CATCCATCTGCCTGTTTATT |
| 202 | ATCCATCTGCCTGTTTATTC |
| 203 | TCCATCTGCCTGTTTATTCA |
| 204 | CCATCTGCCTGTTTATTCAT |
| 205 | CTACTCTTTATCCATCCAC |
| 206 | ACTCTTTATCCATCCACAC |
| 207 | CTCTTTTATCCATCCACACA |
| 208 | TCTTTTATCCATCCACACAC |
| 209 | CTTTTATCCATCCACACACC |
| 210 | TTTTATCCATCCACACACCC |
| 211 | TTTATCCATCCACACACCCA |
| 212 | TTATCCATCCACACACCCAC |
| 213 | TATCCATCCACACACCCACC |
| 214 | ATCCATCCACACACCCACCC |
| 215 | TCCATCCACACACCCACCCA |
| 216 | CCATCCACACACCCACCCAT |
| 217 | CATCCACACACCCACCCATC |
| 218 | ATCCACACACCCACCCATCT |
| 219 | TCCACACACCCACCCATCTA |
| 220 | CCACACACCCACCCATCTAA |
| 221 | CACACACCCACCCATCTAAC |
| 222 | ACACACCCACCCATCTAACT |
| 223 | CACACCCACCCATCTAACTA |
| 224 | ACACCCACCCATCTAACTAC |
| 225 | CACCCACCCATCTAACTACC |
| 226 | ACCCACCCATCTAACTACCC |
| 227 | CCCACCCATCTAACTACCCC |
| 228 | CCACCCATCTAACTACCCCA |
| 229 | CACCCATCTAACTACCCCAA |
| 230 | ACCCATCTAACTACCCCAAA |
| 231 | CCCATCTAACTACCCCAAAT |
| 232 | CCATCTAACTACCCCAAATT |
| 233 | AATTTCACCCATCCACTCTT |
| 234 | ATTTCACCCATCCACTCTTC |
| 235 | TTTCACCCATCCACTCTTCC |
| 236 | TTCACCCATCCACTCTTCCA |
| 237 | TCACCCATCCACTCTTCCAA |
| 238 | CACCCATCCACTCTTCCAAC |
| 239 | ACCCATCCACTCTTCCAACC |
| 240 | CCCATCCACTCTTCCAACCT |
| 241 | CCATCCACTCTTCCAACCTT |
| 242 | CATCCACTCTTCCAACCTTT |
| 243 | ATCCACTCTTCCAACCTTTC |
| 244 | TCCACTCTTCCAACCTTTCA |
| 245 | CCACTCTTCCAACCTTTCAG |
| 246 | CACTCTTCCAACCTTTCAGT |
| 247 | ACTCTTCCAACCTTTCAGTA |
| 248 | CTCTTCCAACCTTTCAGTAA |
| 249 | CCTTTCAGTAATTCAACCAC |
| 250 | CAGTAATTCAACCACACATC |
| 251 | AGTAATTCAACCACACATCC |
| 252 | GTAATTCAACCACACATCCA |
| 253 | AATTCAACCACACATCCATC |
| 254 | ATTCAACCACACATCCATCC |
| 255 | TTCAACCACACATCCATCCA |
| 256 | TCAACCACACATCCATCCAT |

TABLE 1-continued

| SEQ ID NO. | Sequence |
| --- | --- |
| 257 | CAACCACACATCCATCCATC |
| 258 | AACCACACATCCATCCATCC |
| 259 | ACCACACATCCATCCATCCA |
| 260 | CCACACATCCATCCATCCAT |
| 261 | CACACATCCATCCATCCATC |
| 262 | ACACATCCATCCATCCATCC |
| 263 | CACATCCATCCATCCATCCA |
| 264 | ACATCCATCCATCCATCCAT |
| 265 | CATCCATCCATCCATCCATT |
| 266 | ATCCATCCATCCATCCATTC |
| 267 | TCCATCCATCCATCCATTCA |
| 268 | CCATCCATCCATCCATTCAT |
| 269 | CATCCATCCATCCATTCATC |
| 270 | ATCCATCCATCCATTCATCC |
| 271 | TCCATCCATCCATTCATCCA |
| 272 | CCATCCATCCATTCATCCAT |
| 273 | CATCCATCCATTCATCCATC |
| 274 | ATCCATCCATTCATCCATCC |
| 275 | TCCATCCATTCATCCATCCC |
| 276 | CCATCCATTCATCCATCCCA |
| 277 | CATCCATTCATCCATCCCAT |
| 278 | ATCCATTCATCCATCCCATA |
| 279 | TCCATTCATCCATCCCATAC |
| 280 | CCATTCATCCATCCCATACA |
| 281 | CATTCATCCATCCCATACAT |
| 282 | TTCATCCATCCCATACATTG |
| 283 | TCATCCATCCCATACATTGA |
| 284 | CATCCATCCCATACATTGAT |
| 285 | ATCCATCCCATACATTGATC |
| 286 | TCCATCCCATACATTGATCC |
| 287 | GCAACTTAATCCACCTACCC |
| 288 | CAACTTAATCCACCTACCCA |
| 289 | AACTTAATCCACCTACCCAA |
| 290 | ACTTAATCCACCTACCCAAT |
| 291 | CTTAATCCACCTACCCAATC |
| 292 | TTAATCCACCTACCCAATCA |
| 293 | TAATCCACCTACCCAATCAT |
| 294 | AATCCACCTACCCAATCATT |
| 295 | ATCCACCTACCCAATCATTC |
| 296 | TCCACCTACCCAATCATTCA |
| 297 | CCACCTACCCAATCATTCAT |
| 298 | CACCTACCCAATCATTCATT |
| 299 | ACCTACCCAATCATTCATTC |
| 300 | CCTACCCAATCATTCATTCT |
| 301 | CTTTCATACAACCAACCATC |
| 302 | TTTCATACAACCAACCATCC |
| 303 | TTCATACAACCAACCATCCA |
| 304 | TCATACAACCAACCATCCAT |
| 305 | CATACAACCAACCATCCATC |
| 306 | ATACAACCAACCATCCATCC |
| 307 | TACAACCAACCATCCATCCA |
| 308 | ACAACCAACCATCCATCCAC |
| 309 | CAACCAACCATCCATCCACC |
| 310 | AACCAACCATCCATCCACCC |
| 311 | ACCAACCATCCATCCACCCA |
| 312 | CCAACCATCCATCCACCCAT |
| 313 | CAACCATCCATCCACCCATC |
| 314 | AACCATCCATCCACCCATCA |
| 315 | ACCATCCATCCACCCATCAA |
| 316 | CCATCCATCCACCCATCAAT |
| 317 | CATCCATCCACCCATCAATT |
| 318 | ATCCATCCACCCATCAATTT |
| 319 | TCCATCCACCCATCAATTTA |
| 320 | CCATCCACCCATCAATTTAT |
| 321 | CATCCACCCATCAATTTATC |
| 322 | ATCCACCCATCAATTTATCC |
| 323 | TCCACCCATCAATTTATCCA |
| 324 | CCACCCATCAATTTATCCAA |
| 325 | CACCCATCAATTTATCCAAC |
| 326 | ACCCATCAATTTATCCAACC |
| 327 | CCCATCAATTTATCCAACCA |
| 328 | ATCCAACCATCCATTTTTCG |
| 329 | TCCAACCATCCATTTTTCGT |
| 330 | CCAACCATCCATTTTTCGTC |
| 331 | CAACCATCCATTTTTCGTCT |
| 332 | AACCATCCATTTTTCGTCTG |
| 333 | ACCATCCATTTTTCGTCTGT |
| 334 | CCATCCATTTTTCGTCTGTC |

TABLE 1-continued

| SEQ ID NO. | Sequence |
|---|---|
| 335 | CATCCATTTTTCGTCTGTCC |
| 336 | ATCCATTTTTCGTCTGTCCA |
| 337 | TCCATTTTTCGTCTGTCCAC |
| 338 | CCATTTTTCGTCTGTCCACC |
| 339 | CATTTTTCGTCTGTCCACCA |
| 340 | ATTTTTGGTGTGTGGAGGAG |
| 341 | TTTTTCGTCTGTCCACCAGC |
| 342 | TTTTCGTCTGTCCACCAGCC |
| 343 | TTTCGTCTGTCCACCAGCCA |
| 344 | TTCGTCTGTCCACCAGCCAC |
| 345 | TCGTCTGTCCACCAGCCACT |
| 346 | GTCTGTCCACCAGCCACTCA |
| 347 | TCTGTCCACCAGCCACTCAC |
| 348 | CTGTCCACCAGCCACTCACA |
| 349 | TGTCCACCAGCCACTCACAA |
| 350 | GTCCACCAGCCACTCACAAC |
| 351 | TCCACCAGCCACTCACAACC |
| 352 | CCACCAGCCACTCACAACCA |
| 353 | CACCAGCCACTCACAACCAT |
| 354 | ACCAGCCACTCACAACCATC |
| 355 | CCAGCCACTCACAACCATCC |
| 356 | CAGCCACTCACAACCATCCA |
| 357 | AGCCACTCACAACCATCCAT |
| 358 | GCCACTCACAACCATCCATC |
| 359 | CCACTCACAACCATCCATCT |
| 360 | CACTCACAACCATCCATCTA |
| 361 | ACTCACAACCATCCATCTAA |
| 362 | CTCACAACCATCCATCTAAA |
| 363 | GCAATAGTTCAACCACACAT |
| 364 | CAATAGTTCAACCACACATC |
| 365 | AATAGTTCAACCACACATCC |
| 366 | ATAGTTCAACCACACATCCT |
| 367 | TAGTTCAACCACACATCCTT |
| 368 | AGTTCAACCACACATCCTTC |
| 369 | GTTCAACCACACATCCTTCC |
| 370 | TTCAACCACACATCCTTCCA |
| 371 | TCAACCACACATCCTTCCAT |
| 372 | CAACCACACATCCTTCCATT |
| 373 | AACCACACATCCTTCCATTC |
| 374 | ACCACACATCCTTCCATTCA |
| 375 | CCACACATCCTTCCATTCAT |
| 376 | CACACATCCTTCCATTCATC |
| 377 | ACACATCCTTCCATTCATCC |
| 378 | CACATCCTTCCATTCATCCA |
| 379 | ACATCCTTCCATTCATCCAC |
| 380 | CATCCTTCCATTCATCCACC |
| 381 | ATCCTTCCATTCATCCACCC |
| 382 | TCCTTCCATTCATCCACCCA |
| 383 | CCTTCCATTCATCCACCCAC |
| 384 | CTTCCATTCATCCACCCACC |
| 385 | TTCCATTCATCCACCCACCC |
| 386 | TCCATTCATCCACCCACCCA |
| 387 | CATTCATCCACCCACCCATT |
| 388 | ATTCATCCACCCACCCATTC |
| 389 | TTCATCCACCCACCCATTCA |
| 390 | TCATCCACCCACCCATTCAT |
| 391 | CATCCACCCACCCATTCATC |
| 392 | ATCCACCCACCCATTCATCC |
| 393 | TCCACCCACCCATTCATCCA |
| 394 | CCACCCACCCATTCATCCAT |
| 395 | CACCCACCCATTCATCCATT |
| 396 | ACCCACCCATTCATCCATTT |
| 397 | CCCACCCATTCATCCATTTG |
| 398 | CCACCCATTCATCCATTTGT |
| 399 | CACCCATTCATCCATTTGTC |
| 400 | ACCCATTCATCCATTTGTCC |
| 401 | CCATTCATCCATTTGTCCAT |
| 402 | CATTCATCCATTTGTCCATC |
| 403 | TTCATCCATTTGTCCATCTG |
| 404 | TCATCCATTTGTCCATCTGC |
| 405 | CATCCATTTGTCCATCTGCC |
| 406 | ATCCATTTGTCCATCTGCCT |
| 407 | TCCATTTGTCCATCTGCCTA |
| 408 | CCATTTGTCCATCTGCCTAT |
| 409 | CATTTGTCCATCTGCCTATA |
| 410 | ATTTGTCCATCTGCCTATAC |
| 411 | TTTGTCCATCTGCCTATACA |
| 412 | TTGTCCATCTGCCTATACAT |

TABLE 1-continued

| SEQ ID NO. | Sequence |
|---|---|
| 413 | TGTCCATCTGCCTATACATC |
| 414 | GTCCATCTGCCTATACATCC |
| 415 | TCCATCTGCCTATACATCCA |
| 416 | CCATCTGCCTATACATCCAT |
| 417 | CATCTGCCTATACATCCATC |
| 418 | ATCTGCCTATACATCCATCC |
| 419 | TCTGCCTATACATCCATCCA |
| 420 | CTGCCTATACATCCATCCAT |
| 421 | TGCCTATACATCCATCCATC |
| 422 | GCCTATACATCCATCCATCC |
| 423 | CCTATACATCCATCCATCCA |
| 424 | CTATACATCCATCCATCCAT |
| 425 | TATACATCCATCCATCCATC |
| 426 | ATACATCCATCCATCCATCC |
| 427 | TACATCCATCCATCCATCCA |
| 428 | ACATCCATCCATCCATCCAT |
| 429 | CATCCATCCATCCATCCATC |
| 430 | ATCCATCCATCCATCCATCC |
| 431 | TCCATCCATCCATCCATCCA |
| 432 | CCATCCATCCATCCATCCAT |
| 433 | CATCCATCCATCCATCCATC |
| 434 | ATCCATCCATCCATCCATCT |
| 435 | TCCATCCATCCATCCATCTA |
| 436 | CCATCCATCCATCCATCTAC |
| 437 | CATCCATCCATCCATCTACC |
| 438 | ATCCATCCATCCATCTACCT |
| 439 | TCCATCCATCCATCTACCTA |
| 440 | CCATCCATCCATCTACCTAT |
| 441 | CATCCATCCATCTACCTATC |
| 442 | ATCCATCCATCTACCTATCT |
| 443 | TCCATCCATCTACCTATCTA |
| 444 | CCATCCATCTACCTATCTAC |
| 445 | CATCCATCTACCTATCTACC |
| 446 | ATCCATCTACCTATCTACCC |
| 447 | TCCATCTACCTATCTACCCA |
| 448 | CCATCTACCTATCTACCCAT |
| 449 | CATCTACCTATCTACCCATC |
| 450 | ATCTACCTATCTACCCATCT |
| 451 | TCTACCTATCTACCCATCTG |
| 452 | CTACCTATCTACCCATCTGA |
| 453 | TACCTATCTACCCATCTGAC |
| 454 | ACCTATCTACCCATCTGACT |
| 455 | CCTATCTACCCATCTGACTA |
| 456 | CTATCTACCCATCTGACTAT |
| 457 | TATCTACCCATCTGACTATC |
| 458 | ATCTACCCATCTGACTATCA |
| 459 | TCTACCCATCTGACTATCAA |
| 460 | CTACCCATCTGACTATCAAC |
| 461 | TACCCATCTGACTATCAACA |
| 462 | ACCCATCTGACTATCAACAA |
| 463 | CCCATCTGACTATCAACAAA |
| 464 | CACCTATCTACTCAATCTTC |
| 465 | ACCTATCTACTCAATCTTCC |
| 466 | CCTATCTACTCAATCTTCCT |
| 467 | CCTTCTAATAACTCAACCAC |
| 468 | AATAACTCAACCACACTTCC |
| 469 | ATAACTCAACCACACTTCCA |
| 470 | TAACTCAACCACACTTCCAT |
| 471 | AACTCAACCACACTTCCATC |
| 472 | ACTCAACCACACTTCCATCC |
| 473 | CTCAACCACACTTCCATCCA |
| 474 | TCAACCACACTTCCATCCAT |
| 475 | CAACCACACTTCCATCCATC |
| 476 | AACCACACTTCCATCCATCC |
| 477 | ACCACACTTCCATCCATCCC |
| 478 | CCACACTTCCATCCATCCCA |
| 479 | CACACTTCCATCCATCCCAT |
| 480 | ACACTTCCATCCATCCCATC |
| 481 | CACTTCCATCCATCCCATCC |
| 482 | ACTTCCATCCATCCCATCCA |
| 483 | CTTCCATCCATCCCATCCAA |
| 484 | TTCCATCCATCCCATCCAAT |
| 485 | TCCATCCATCCCATCCAATA |
| 486 | CCATCCATCCCATCCAATAC |
| 487 | CATCCATCCCATCCAATACA |
| 488 | ATCCATCCCATCCAATACAA |
| 489 | TCCATCCCATCCAATACAAC |
| 490 | CCATCCCATCCAATACAACT |

TABLE 1-continued

| SEQ ID NO. | Sequence |
|---|---|
| 491 | CATCCCATCCAATACAACTT |
| 492 | ACAACTTAATCTGCTCATCC |
| 493 | CAACTTAATCTGCTCATCCA |
| 494 | ACTTAATCTGCTCATCCAAC |
| 495 | CTTAATCTGCTCATCCAACA |
| 496 | ATCTGCTCATCCAACATTTC |
| 497 | TCTGCTCATCCAACATTTCA |
| 498 | CTGCTCATCCAACATTTCAT |
| 499 | TGCTCATCCAACATTTCATC |
| 500 | GCTCATCCAACATTTCATCT |
| 501 | CCAACATTTCATCTATCCAC |
| 502 | CAACATTTCATCTATCCACC |
| 503 | AACATTTCATCTATCCACCC |
| 504 | ACATTTCATCTATCCACCCA |
| 505 | CATTTCATCTATCCACCCAG |
| 506 | ATTTCATCTATCCACCCAGT |
| 507 | TTTCATCTATCCACCCAGTC |
| 508 | TTCATCTATCCACCCAGTCA |
| 509 | TCATCTATCCACCCAGTCAA |
| 510 | CATCTATCCACCCAGTCAAT |
| 511 | ATCTATCCACCCAGTCAATC |
| 512 | TCTATCCACCCAGTCAATCA |
| 513 | CTATCCACCCAGTCAATCAT |
| 514 | TATCCACCCAGTCAATCATC |
| 515 | ATCCACCCAGTCAATCATCT |
| 516 | TCCACCCAGTCAATCATCTA |
| 517 | CCACCCAGTCAATCATCTAT |
| 518 | CACCCAGTCAATCATCTATC |
| 519 | ACCCAGTCAATCATCTATCC |
| 520 | CCCAGTCAATCATCTATCCA |
| 521 | CCAGTCAATCATCTATCCAG |
| 522 | CAGTCAATCATCTATCCAGC |
| 523 | AGTCAATCATCTATCCAGCA |
| 524 | GTCAATCATCTATCCAGCAA |
| 525 | CAATCATCTATCCAGCAATC |
| 526 | CATCTATCCAGCAATCTATC |
| 527 | ATCCAGCAATCTATCTATCC |
| 528 | TCCAGCAATCTATCTATCCA |
| 529 | CCAGCAATCTATCTATCCAC |
| 530 | CAGCAATCTATCTATCCACT |
| 531 | AGCAATCTATCTATCCACTC |
| 532 | GCAATCTATCTATCCACTCA |
| 533 | CTATCTATCCACTCATCAAG |
| 534 | ATCCACTCATCAAGTTATCC |
| 535 | TCCACTCATCAAGTTATCCA |
| 536 | CCACTCATCAAGTTATCCAT |
| 537 | CACTCATCAAGTTATCCATC |
| 538 | ACTCATCAAGTTATCCATCC |
| 539 | CTCATCAAGTTATCCATCCA |
| 540 | CATCAAGTTATCCATCCATC |
| 541 | CCATCATCTAACAATTACCC |
| 542 | CATCATCTAACAATTACCCC |
| 543 | ATCATCTAACAATTACCCCC |
| 544 | TCATCTAACAATTACCCCCA |
| 545 | CATCTAACAATTACCCCCAA |
| 546 | ACAATTACCCCCAAATTCAC |
| 547 | CAATTACCCCCAAATTCACC |
| 548 | CCATCCCATACATTGATCCG |
| 549 | CATCCCATACATTGATCCGC |
| 550 | ATCCCATACATTGATCCGCA |
| 551 | TCCCATACATTGATCCGCAA |
| 552 | CCCATACATTGATCCGCAAC |
| 553 | CCATACATTGATCCGCAACT |
| 554 | CATACATTGATCCGCAACTT |
| 555 | CATTGATCCGCAACTTAATC |
| 556 | ATTGATCCGCAACTTAATCC |
| 557 | TTGATCCGCAACTTAATCCA |
| 558 | TGATCCGCAACTTAATCCAC |
| 559 | GATCCGCAACTTAATCCACC |
| 560 | ATCCGCAACTTAATCCACCT |
| 561 | TCCGCAACTTAATCCACCTA |
| 562 | CCGCAACTTAATCCACCTAC |
| 563 | CGCAACTTAATCCACCTACC |
| 564 | CCATTCATCCACCCACCCAT |
| 565 | CCCATTCATCCATTTGTCCA |
| 566 | CCATCATCCATCTAGCCACG |
| 567 | CATCATCCATCTAGCCACGA |
| 568 | ATCATCCATCTAGCCACGAA |

TABLE 1-continued

| SEQ ID NO. | Sequence |
|---|---|
| 569 | TCATCCATCTAGCCACGAAT |
| 570 | CATCCATCTAGCCACGAATC |
| 571 | ATCCATCTAGCCACGAATCT |
| 572 | TCCATCTAGCCACGAATCTA |
| 573 | CCATCTAGCCACGAATCTAC |
| 574 | CATCTAGCCACGAATCTACC |
| 575 | ATCTAGCCACGAATCTACCC |
| 576 | TCTAGCCACGAATCTACCCA |
| 577 | CTAGCCACGAATCTACCCAC |
| 578 | TAGCCACGAATCTACCCACC |
| 579 | AGCCACGAATCTACCCACCA |
| 580 | GCCACGAATCTACCCACCAA |
| 581 | CCACGAATCTACCCACCAAC |
| 582 | CACGAATCTACCCACCAACT |
| 583 | ACGAATCTACCCACCAACTC |
| 584 | CGAATCTACCCACCAACTCA |
| 585 | GACATACCCAGACACAAACG |
| 586 | ACATACCCAGACACAAACGG |
| 587 | CATACCCAGACACAAACGGC |
| 588 | GCCAGAAAGAGGAAGAGCTG |
| 589 | CCAGAAAGAGGAAGAGCTGG |
| 590 | GGCAGGCAGGAATGGTGAGT |
| 591 | GCAGGCAGGAATGGTGAGTG |
| 592 | CAGGCAGGAATGGTGAGTGG |
| 593 | AGGCAGGAATGGTGAGTGGA |
| 594 | GGCAGGAATGGTGAGTGGAA |
| 595 | GCAGGAATGGTGAGTGGAAG |
| 596 | CAGGAATGGTGAGTGGAAGT |
| 597 | AGGAATGGTGAGTGGAAGTG |
| 598 | GGAATGGTGAGTGGAAGTGG |
| 599 | GAATGGTGAGTGGAAGTGGC |
| 600 | AATGGTGAGTGGAAGTGGCA |
| 601 | ATGGTGAGTGGAAGTGGCAT |
| 602 | TGGTGAGTGGAAGTGGCATG |
| 603 | GGTGAGTGGAAGTGGCATGG |
| 604 | TCATTCATCTGT |
| 605 | CTCATTCATCTG |
| 606 | ACTCATTCATCT |
| 607 | CACTCATTCATC |
| 608 | TCACTCATTCAT |
| 609 | ATCACTCATTCA |
| 610 | CATCACTCATTC |
| 611 | TCATCACTCATT |
| 612 | CTCATCACTCAT |
| 613 | CACTCATTCATCTGT |
| 614 | TCACTCATTCATCTG |
| 615 | ATCACTCATTCATCT |
| 616 | CATCACTCATTCATC |
| 617 | TCATCACTCATTCAT |
| 618 | CTCATCACTCATTCA |
| 619 | TCACTCATTCATCTGT |
| 620 | ATCACTCATTCATCTG |
| 621 | CATCACTCATTCATCT |
| 622 | TCATCACTCATTCATC |
| 623 | CTCATCACTCATTCAT |
| 624 | ATCACTCATTCATCTGT |
| 625 | CATCACTCATTCATCTG |
| 626 | TCATCACTCATTCATCT |
| 627 | CTCATCACTCATTCATC |
| 628 | CATCACTCATTCATCTGT |
| 629 | TCATCACTCATTCATCTG |
| 630 | CTCATCACTCATTCATCT |
| 631 | TCATCACTCATTCATCTGT |
| 632 | CTCATCACTCATTCATCTG |
| 633 | CTCATCACTCATTCATCTGTT |
| 634 | ACTCATCACTCATTCATCTGT |
| 635 | CTCATCACTCATTCATCTGTTC |
| 636 | ACTCATCACTCATTCATCTGTT |
| 637 | TACTCATCACTCATTCATCTGT |
| 638 | CTCATCACTCATTCATCTGTTCA |
| 639 | ACTCATCACTCATTCATCTGTTC |
| 640 | TACTCATCACTCATTCATCTGTT |
| 641 | CTACTCATCACTCATTCATCTGT |

As shown in FIGS. 4A-4F, ASO 55 (SEQ ID. NO. 55) variations listed above are alternately labeled as below, to be more clearly identifiable as variations of ASO 55:

| SEQ ID NO. | Alternate Identifier |
|---|---|
| 604 | hUNC13A-ASO55_12-1 |
| 605 | hUNC13A-ASO55_12-2 |
| 606 | hUNC13A-ASO55_12-3 |
| 607 | hUNC13A-ASO55_12-4 |
| 608 | hUNC13A-ASO55_12-5 |
| 609 | hUNC13A-ASO55_12-6 |
| 610 | hUNC13A-ASO55_12-7 |
| 611 | hUNC13A-ASO55_12-8 |
| 612 | hUNC13A-ASO55_12-9 |
| 613 | hUNC13A-ASO55_15-1 |
| 614 | hUNC13A-ASO55_15-2 |
| 615 | hUNC13A-ASO55_15-3 |
| 616 | hUNC13A-ASO55_15-4 |
| 617 | hUNC13A-ASO55_15-5 |
| 618 | hUNC13A-ASO55_15-6 |
| 619 | hUNC13A-ASO55_16-1 |
| 620 | hUNC13A-ASO55_16-2 |
| 621 | hUNC13A-ASO55_16-3 |
| 622 | hUNC13A-ASO55_16-4 |
| 623 | hUNC13A-ASO55_16-5 |
| 624 | hUNC13A-ASO55_17-1 |
| 625 | hUNC13A-ASO55_17-2 |
| 626 | hUNC13A-ASO55_17-3 |
| 627 | hUNC13A-ASO55_17-4 |
| 628 | hUNC13A-ASO55_18-1 |
| 629 | hUNC13A-ASO55_18-2 |
| 630 | hUNC13A-ASO55_18-3 |
| 631 | hUNC13A-ASO55_19-1 |
| 632 | hUNC13A-ASO55_19-2 |
| 633 | hUNC13A-ASO55_21-1 |
| 634 | hUNC13A-ASO55_21-2 |
| 635 | hUNC13A-ASO55_22-1 |
| 636 | hUNC13A-ASO55_22-2 |
| 637 | hUNC13A-ASO55_22-3 |
| 638 | hUNC13A-ASO55_23-1 |
| 639 | hUNC13A-ASO55_23-2 |
| 640 | hUNC13A-ASO55_23-3 |
| 641 | hUNC13A-ASO55_23-4 |

In one embodiment, the disclosure provides modified oligonucleotides consisting of 12-30 linked nucleosides and having a nucleobase sequence comprising at least 8, at least 9, at least 10, at least 11 at least 12, at least 13, at least 14, at least 15, at least 16, at least 17, at least 18, at least 19 or at least 20 consecutive nucleotide bases of any of the nucleobase sequences of SEQ ID NO:1-641 in Table 1. In some embodiments, the modified oligonucleotide is at least 80% to 100% (i.e., 80%, 82%, 84%, 86%, 88%, 90%, 92%, 94%, 96%, 98% or 100%; or any numerical range or value between any of the foregoing values) identical to any of the sequences comprising or consisting of SEQ ID NO:1-641. The sequences provided in Table 1 can be used to design antisense molecules for inhibition of UNC13A cryptic exon expression.

In some embodiments, the oligonucleotide is single stranded. In some embodiments the oligonucleotide comprises or is complexed with a moiety that neutralizes charge on the oligonucleotide to promote uptake and transfer across a cell membrane.

In another embodiment, each of the ASOs in Table 1 has a motif where each nucleobase has a 2'-OCH$_2$CH$_2$—OCH$_3$ group (i.e., 2'-MOE) and each internucleoside linkage is a phosphorothioate linkage. This would be the motif: 2MOE*2MOE*2MOE*2MOE*2MOE*2MOE*2MOE* 2MOE*2MOE*2MOE*2MOE*2MOE* 2MOE*2MOE*2MOE*2MOE*2MOE*2MOE* 2MOE where (i) 2MOE is a nucleobase with a 2'-OCH$_2$CH$_2$—OCH$_3$ group (i.e., 2'-MOE), and (ii) the asterisk (*) refers to a phosphorothioate linkage. Table 2 below shows this motif.

Table 2: The Sequence of Bases in UNC13A Antisense Oligonucleotides (ASOs). Capital letters are 2'-methoxyethylribose nucleosides; lower case are DNA nucleosides; asterisks (*) are phosphorothioate linkages; linkages which do not have an asterisk are phosphodiester linkages)

TABLE 2

| SEQ ID NO. | Sequence |
|---|---|
| 642 | G*A*A*T*C*T*A*C*C*C*A*C*C*A*A*C*T*C*A*T |
| 643 | A*A*T*C*T*A*C*C*C*A*C*C*A*A*C*T*C*A*T*C |
| 644 | A*T*C*T*A*C*C*C*A*C*C*A*A*C*T*C*A*T*C*C |
| 645 | T*C*T*A*C*C*C*A*C*C*A*A*C*T*C*A*T*C*C*A |
| 646 | C*T*A*C*C*C*A*C*C*A*A*C*T*C*A*T*C*C*A*T |
| 647 | T*A*C*C*C*A*C*C*A*A*C*T*C*A*T*C*C*A*T*C |
| 648 | A*C*C*C*A*C*C*A*A*C*T*C*A*T*C*C*A*T*C*T |
| 649 | C*C*C*A*C*C*A*A*C*T*C*A*T*C*C*A*T*C*T*A |
| 650 | C*C*A*C*C*A*A*C*T*C*A*T*C*C*A*T*C*T*A*T |
| 651 | C*A*C*C*A*A*C*T*C*A*T*C*C*A*T*C*T*A*T*C |
| 652 | A*C*C*A*A*C*T*C*A*T*C*C*A*T*C*T*A*T*C*C |
| 653 | C*C*A*A*C*T*C*A*T*C*C*A*T*C*T*A*T*C*C*A |
| 654 | C*A*A*C*T*C*A*T*C*C*A*T*C*T*A*T*C*C*A*T |
| 655 | A*A*C*T*C*A*T*C*C*A*T*C*T*A*T*C*C*A*T*C |
| 656 | A*C*T*C*A*T*C*C*A*T*C*T*A*T*C*C*A*T*C*C |
| 657 | C*T*C*A*T*C*C*A*T*C*T*A*T*C*C*A*T*C*C*A |
| 658 | T*C*A*T*C*C*A*T*C*T*A*T*C*C*A*T*C*C*A*T |
| 659 | C*A*T*C*C*A*T*C*T*A*T*C*C*A*T*C*C*A*T*G |
| 660 | A*T*C*C*A*T*C*T*A*T*C*C*A*T*C*C*A*T*G*T |
| 661 | T*C*C*A*T*C*T*A*T*C*C*A*T*C*C*A*T*G*T*A |
| 662 | C*C*A*T*C*T*A*T*C*C*A*T*C*C*A*T*G*T*A*C |
| 663 | C*A*T*C*T*A*T*C*C*A*T*C*C*A*T*G*T*A*C*T |
| 664 | A*T*C*T*A*T*C*C*A*T*C*C*A*T*G*T*A*C*T*C |
| 665 | T*C*T*A*T*C*C*A*T*C*C*A*T*G*T*A*C*T*C*A |
| 666 | C*T*A*T*C*C*A*T*C*C*A*T*G*T*A*C*T*C*A*C |
| 667 | T*A*T*C*C*A*T*C*C*A*T*G*T*A*C*T*C*A*C*C |
| 668 | A*T*C*C*A*T*C*C*A*T*G*T*A*C*T*C*A*C*C*C |
| 669 | T*C*C*A*T*C*C*A*T*G*T*A*C*T*C*A*C*C*C*A |
| 670 | Q*Q*A*T*C*C*A*T*G*T*A*C*T*C*A*C*C*C*A*T |
| 671 | C*A*T*C*C*A*T*G*T*A*C*T*C*A*C*C*C*A*T*C |
| 672 | A*T*C*C*A*T*G*T*A*C*T*C*A*C*C*C*A*T*C*T |
| 673 | T*C*C*A*T*G*T*A*C*T*C*A*C*C*C*A*T*C*T*C |
| 674 | C*C*A*T*G*T*A*C*T*C*A*C*C*C*A*T*C*T*C*T |
| 675 | C*A*T*G*T*A*C*T*C*A*C*C*C*A*T*C*T*C*T*C |
| 676 | A*T*G*T*A*C*T*C*A*C*C*C*A*T*C*T*C*T*C*C |

TABLE 2-continued

| SEQ ID NO. | Sequence |
|---|---|
| 677 | T*G*T*A*C*T*C*A*C*C*C*A*T*C*T*C*T*C*C*A |
| 678 | G*T*A*C*T*C*A*C*C*C*A*T*C*T*C*T*C*C*A*T |
| 679 | T*A*C*T*C*A*C*C*C*A*T*C*T*C*T*C*C*A*T*C |
| 680 | A*C*T*C*A*C*C*C*A*T*C*T*C*T*C*C*A*T*C*C |
| 681 | C*T*C*A*C*C*C*A*T*C*T*C*T*C*C*A*T*C*C*A |
| 682 | T*C*A*C*C*C*A*T*C*T*C*T*C*C*A*T*C*C*A*T |
| 683 | C*A*C*C*C*A*T*C*T*C*T*C*C*A*T*C*C*A*T*C |
| 684 | A*C*C*C*A*T*C*T*C*T*C*C*A*T*C*C*A*T*C*C |
| 685 | C*C*C*A*T*C*T*C*T*C*C*A*T*C*C*A*T*C*C*T |
| 686 | C*C*A*T*C*T*C*T*C*C*A*T*C*C*A*T*C*C*T*T |
| 687 | C*A*T*C*T*C*T*C*C*A*T*C*C*A*T*C*C*T*T*T |
| 688 | A*T*C*T*C*T*C*C*A*T*C*C*A*T*C*C*T*T*T*T |
| 689 | T*C*T*C*T*C*C*A*T*C*C*A*T*C*C*T*T*T*T*A |
| 690 | C*T*C*T*C*C*A*T*C*C*A*T*C*C*T*T*T*T*A*T |
| 691 | T*C*T*C*C*A*T*C*C*A*T*C*C*T*T*T*T*A*T*C |
| 692 | C*T*C*C*A*T*C*C*A*T*C*C*T*T*T*T*A*T*C*T |
| 693 | C*C*A*T*C*C*A*T*C*C*T*T*T*T*A*T*C*T*A*C |
| 694 | C*T*A*C*T*C*A*T*C*A*C*T*C*A*T*T*C*A*T*C |
| 695 | A*C*T*C*A*T*C*A*C*T*C*A*T*T*C*A*T*C*T*G |
| 696 | C*T*C*A*T*C*A*C*T*C*A*T*T*C*A*T*C*T*G*T |
| 697 | C*A*T*C*A*C*T*C*A*T*T*C*A*T*C*T*G*T*T*C |
| 698 | T*C*A*T*T*C*A*T*T*T*C*A*T*T*T*C*A*C*C*A*G*C |
| 699 | C*A*T*T*C*A*T*T*T*C*A*T*T*T*C*A*C*C*A*G*C*A |
| 700 | G*A*A*T*A*A*G*A*G*T*T*C*T*T*T*T*C*C*A*G*G |
| 701 | G*A*T*A*A*G*A*G*T*T*C*T*T*T*T*C*C*A*G*G*A |
| 702 | T*T*C*C*A*G*G*A*A*A*C*C*C*A*G*G*C*A*G*C |
| 703 | T*C*C*A*G*G*A*A*A*C*C*C*A*G*G*C*A*G*C*T |
| 704 | A*G*C*T*G*G*A*A*A*G*A*G*A*C*A*T*A*C*C*C*A |
| 705 | G*C*T*G*G*A*A*A*G*A*G*A*C*A*T*A*C*C*C*A*G |
| 706 | C*T*G*G*A*A*A*G*A*G*A*C*A*T*A*C*C*C*A*G*A |
| 707 | T*G*G*A*A*A*G*A*G*A*C*A*T*A*C*C*C*A*G*A*C |
| 708 | G*G*A*A*A*G*A*G*A*C*A*T*A*C*C*C*A*G*A*C*A |
| 709 | G*A*A*A*G*A*G*A*C*A*T*A*C*C*C*A*G*A*C*A*C |
| 710 | A*A*G*A*G*A*C*A*A*T*A*C*C*C*A*G*A*C*A*C*A |
| 711 | A*G*A*G*A*C*A*A*T*A*C*C*C*A*G*A*C*A*C*A*A |
| 712 | G*A*G*A*C*A*A*T*A*C*C*C*A*G*A*C*A*C*A*A*A |
| 713 | A*G*A*C*A*A*T*A*C*C*C*A*G*A*C*A*C*A*A*A*C |
| 714 | G*C*C*C*A*A*T*C*C*T*G*A*G*T*G*G*T*T*A*G |
| 715 | C*C*C*A*A*T*C*C*T*G*A*G*T*G*G*T*T*A*G*G |
| 716 | G*C*T*G*G*A*A*T*A*G*A*A*G*G*A*A*G*A*A |
| 717 | G*C*T*G*G*A*A*T*A*G*A*A*G*G*A*A*G*A*A*C |
| 718 | C*T*G*G*A*A*T*A*G*A*A*G*G*A*A*G*A*A*C*C |
| 719 | T*G*G*A*A*T*A*G*A*A*G*G*A*A*G*A*A*C*C*T |
| 720 | G*G*A*A*T*A*G*A*A*G*G*A*A*G*A*A*C*C*T*G |
| 721 | G*A*A*T*A*G*A*A*G*G*A*A*G*A*A*C*C*T*G*A |
| 722 | A*T*A*G*A*A*G*G*A*A*G*A*A*C*C*T*G*A*T*G |
| 723 | T*A*G*A*A*G*G*A*A*G*A*A*C*C*T*G*A*T*G*A |
| 724 | A*G*A*A*G*G*A*A*G*A*A*C*C*T*G*A*T*G*A*T |
| 725 | G*A*A*G*G*A*A*G*A*A*C*C*T*G*A*T*G*A*T*G |
| 726 | A*A*G*G*A*A*G*A*A*C*C*T*G*A*T*G*A*T*G*A |
| 727 | A*G*G*A*A*G*A*A*C*C*T*G*A*T*G*A*T*G*A*G |
| 728 | G*G*A*A*G*A*A*C*C*T*G*A*T*G*A*T*G*A*G*T |
| 729 | G*A*A*G*A*A*C*C*T*G*A*T*G*A*T*G*A*G*T*A |
| 730 | A*A*G*A*A*C*C*T*G*A*T*G*A*T*G*A*G*T*A*G |
| 731 | A*G*A*A*C*C*T*G*A*T*G*A*T*G*A*G*T*A*G*T |
| 732 | G*A*A*C*C*T*G*A*T*G*A*T*G*A*G*T*A*G*T*G |
| 733 | A*A*C*C*T*G*A*T*G*A*T*G*A*G*T*A*G*T*G*A |
| 734 | A*C*C*T*G*A*T*G*A*T*G*A*G*T*A*G*T*G*A*G |
| 735 | C*C*T*G*A*T*G*A*T*G*A*G*T*A*G*T*G*A*G*A |
| 736 | C*T*G*A*A*G*A*T*G*A*G*A*A*G*A*G*A*G*A*G |
| 737 | T*G*A*T*G*A*G*A*G*T*A*G*T*G*A*G*A*G*T |
| 738 | G*A*A*G*A*T*G*A*G*A*G*A*G*A*G*A*G*T*C |
| 739 | A*A*G*A*T*G*A*G*T*A*G*A*G*A*G*A*G*A*C*A |
| 740 | T*G*A*T*G*A*G*A*A*G*A*G*A*G*A*G*A*C*A*A |
| 741 | G*A*T*G*A*G*T*A*G*T*G*A*G*A*G*T*C*A*A*C |
| 742 | A*T*G*A*G*T*A*G*T*G*A*G*A*G*T*C*A*A*C*C |
| 743 | T*G*A*G*T*A*G*T*G*A*G*A*G*T*C*A*A*C*C*T |
| 744 | G*A*G*T*A*G*T*G*A*G*A*G*T*C*A*A*C*C*T*G |
| 745 | A*G*T*A*G*T*G*A*G*A*G*T*C*A*A*C*C*T*G*G |
| 746 | G*T*A*G*T*G*A*G*A*G*T*C*A*A*C*C*T*G*G*A |
| 747 | T*A*G*T*G*A*G*A*G*T*C*A*A*C*C*T*G*G*A*G |
| 748 | A*G*T*G*A*G*A*G*T*C*A*A*C*C*T*G*G*A*G*G |
| 749 | G*T*G*A*G*A*G*T*C*A*A*C*C*T*G*G*A*G*G*C |
| 750 | T*T*C*C*A*G*A*G*G*A*G*G*T*G*A*C*C*C*T |
| 751 | C*C*A*G*A*G*A*G*G*T*G*A*C*C*C*T*G*A*A |
| 752 | C*A*G*A*G*A*G*G*T*G*A*C*C*C*T*G*A*A*T |

TABLE 2-continued

| SEQ ID NO. | Sequence |
|---|---|
| 753 | A*G*A*G*A*G*T*G*A*C*C*C*T*G*A*A*T*C |
| 754 | G*A*G*A*G*T*G*A*C*C*C*T*G*A*A*T*C*T |
| 755 | A*G*A*G*T*G*A*C*C*C*T*G*A*A*T*C*T*G |
| 756 | G*G*A*G*T*G*A*C*C*C*T*G*A*A*T*C*T*G |
| 757 | G*A*G*T*G*A*C*C*C*T*G*A*A*T*C*T*G*G*A |
| 758 | A*G*G*T*G*A*C*C*C*T*G*A*A*T*C*T*G*G*A*C |
| 759 | G*G*T*G*A*C*C*C*T*G*A*A*T*C*T*G*G*A*C*T |
| 760 | G*T*G*A*C*C*C*T*G*A*A*T*C*T*G*G*A*C*T*T |
| 761 | T*G*A*C*C*C*T*G*A*A*T*C*T*G*G*A*C*T*T*T |
| 762 | G*A*C*C*C*T*G*A*A*T*C*T*G*G*A*C*T*T*T*G |
| 763 | A*C*C*C*T*G*A*A*T*C*T*G*G*A*C*T*T*T*G*A |
| 764 | C*C*C*T*G*A*A*T*C*T*G*G*A*C*T*T*T*G*A*T |
| 765 | G*T*G*A*A*T*C*T*G*G*A*C*T*T*T*G*A*T*G |
| 766 | G*T*G*A*A*T*C*T*G*G*A*C*T*T*T*G*A*T*G*G |
| 767 | T*G*A*A*T*C*A*G*G*A*C*T*T*T*G*A*A*G*G*A |
| 768 | G*A*A*A*C*T*G*G*A*C*T*T*T*G*A*A*G*G*A*T |
| 769 | A*A*C*T*G*G*A*C*T*T*T*G*A*A*G*G*A*T*A*G |
| 770 | T*C*A*G*G*A*C*A*A*A*G*A*T*G*G*A*A*A*G*G |
| 771 | G*G*A*G*A*G*T*T*T*T*C*A*G*G*T*A*A*A |
| 772 | G*A*G*A*G*T*T*T*T*C*A*G*G*T*A*A*A*G |
| 773 | A*G*A*G*T*T*T*T*C*C*A*G*G*T*A*A*A*G*G |
| 774 | G*C*A*G*G*A*G*A*G*T*G*T*G*A*T*G*G*T |
| 775 | C*C*A*G*G*A*G*A*G*T*G*T*G*A*A*G*G*T*G |
| 776 | C*A*G*G*A*G*A*G*A*G*T*G*G*A*A*G*G*A*G*T |
| 777 | A*G*G*A*G*A*G*A*G*A*G*A*A*G*G*A*A*G |
| 778 | G*A*G*A*G*A*G*A*G*A*A*G*G*A*G*A*G*G |
| 779 | G*A*G*A*G*T*G*A*G*G*A*A*G*G*A*G*G*C |
| 780 | A*A*T*T*A*C*C*C*C*A*A*A*T*T*C*A*C*C*C |
| 781 | A*T*T*A*C*C*C*C*A*A*A*T*T*C*A*C*C*C*A |
| 782 | T*T*A*C*C*C*C*C*A*A*A*T*T*C*A*C*C*C*A*T |
| 783 | T*A*C*C*C*C*A*A*A*T*T*C*A*C*C*C*A*T*C |
| 784 | A*C*C*C*C*C*A*A*A*T*T*C*A*C*C*C*A*T*C*C |
| 785 | C*C*C*C*A*A*A*T*T*C*A*C*C*C*A*T*C*C*A |
| 786 | C*C*C*C*A*A*A*T*T*C*A*C*C*C*A*T*C*C*A*T |
| 787 | C*C*C*A*A*A*T*T*C*A*C*C*C*A*T*C*C*A*T*A |
| 788 | C*C*A*A*A*T*T*C*A*C*C*C*A*T*C*C*A*T*A*C |
| 789 | C*A*A*A*T*T*C*A*C*C*C*A*T*C*C*A*T*A*C*A |
| 790 | A*A*T*T*C*A*C*C*C*A*T*C*C*A*T*A*C*A*T*C |

| SEQ ID NO. | Sequence |
|---|---|
| 791 | A*T*T*C*A*C*C*C*A*T*C*C*A*T*A*C*A*T*C*T |
| 792 | T*T*C*A*C*C*C*A*T*C*C*A*T*A*C*A*T*C*T*A |
| 793 | T*C*A*C*C*C*A*T*C*C*A*T*A*C*A*T*C*T*A*T |
| 794 | C*A*C*C*C*A*T*C*C*A*T*A*C*A*T*C*T*A*T*A |
| 795 | A*C*C*C*A*T*C*C*A*T*A*C*A*T*C*T*A*T*A*C |
| 796 | C*C*C*A*T*C*C*A*T*A*C*A*T*C*T*A*T*A*C*T |
| 797 | Q*A*T*A*T*A*T*C*C*A*T*C*C*A*T*C*T*G*T*C |
| 798 | A*T*A*T*A*T*C*C*A*T*C*C*A*T*C*T*G*T*C*C |
| 799 | T*A*T*A*T*C*A*T*C*C*A*T*C*T*G*T*C*C*A |
| 800 | A*T*A*T*C*A*T*C*C*A*T*C*T*G*T*C*C*A*T |
| 801 | T*A*T*C*A*T*C*C*A*T*C*T*G*T*C*C*A*T*C |
| 802 | A*T*C*A*T*C*C*A*T*C*T*G*T*C*C*A*T*C*C |
| 803 | T*C*C*A*T*C*C*A*T*C*T*G*T*C*C*A*T*C*C*A |
| 804 | C*C*A*T*C*C*A*T*C*T*G*T*C*C*A*T*C*C*A*T |
| 805 | C*A*T*C*C*A*T*C*T*G*T*C*C*A*T*C*C*A*T*C |
| 806 | A*T*C*C*A*T*C*T*G*T*C*C*A*T*C*C*A*T*C*C |
| 807 | T*C*C*A*T*C*T*G*T*C*C*A*T*C*C*A*T*C*C*A |
| 808 | C*C*A*T*C*T*G*T*C*C*A*T*C*C*A*T*C*C*A*T |
| 809 | C*A*T*C*T*G*T*C*C*A*T*C*C*A*T*C*C*A*T*C |
| 810 | A*T*C*T*G*T*C*C*A*T*C*C*A*T*C*C*A*T*C*A |
| 811 | T*C*T*G*T*C*C*A*T*C*C*A*T*C*C*A*T*C*A*T |
| 812 | C*T*G*T*C*C*A*T*C*C*A*T*C*C*A*T*C*A*T*C |
| 813 | T*G*T*C*C*A*T*C*C*A*T*C*C*A*T*C*A*T*C*C |
| 814 | G*T*C*C*A*T*C*C*A*T*C*C*A*T*C*A*T*C*C*A |
| 815 | T*C*C*A*T*C*C*A*T*C*C*A*T*C*A*T*C*C*A*T |
| 816 | C*C*A*T*C*C*A*T*C*C*A*T*C*A*T*C*C*A*T*C |
| 817 | C*A*T*C*C*A*T*C*C*A*T*C*A*T*C*C*A*T*C*T |
| 818 | A*T*C*C*A*T*C*C*A*T*C*A*T*C*C*A*T*C*T*A |
| 819 | T*C*C*A*T*C*C*A*T*C*A*T*C*C*A*T*C*T*A*G |
| 820 | C*C*A*T*C*C*A*T*C*A*T*C*C*A*T*C*T*A*G*C |
| 821 | C*A*T*C*C*A*T*C*A*T*C*C*A*T*C*T*A*G*C*C |
| 822 | A*T*C*C*A*T*C*A*T*C*C*A*T*C*T*A*G*C*C*A |
| 823 | T*C*C*A*T*C*A*T*C*C*A*T*C*T*A*G*C*C*A*C |
| 824 | G*G*A*G*A*G*A*A*G*A*G*A*C*A*A*G*A*G*A*G |
| 825 | G*A*C*A*G*A*A*A*G*A*C*A*C*A*A*G*A*G*A |
| 826 | A*G*A*A*A*A*G*A*G*A*C*A*A*G*G*A*G*A*G |
| 827 | G*A*G*A*A*A*G*A*G*A*C*A*A*G*G*A*G*A*G*T |
| 828 | A*G*A*A*A*G*A*G*A*C*A*A*G*G*A*G*A*G*A*G |

TABLE 2-continued

| SEQ ID NO. | Sequence |
|---|---|
| 829 | G*A*A*A*G*T*G*T*C*A*T*G*G*A*G*A*G*T*G*C |
| 830 | G*G*C*A*G*C*T*T*A*C*A*T*C*A*T*C*C*A*T*C |
| 831 | G*C*A*G*C*T*T*A*C*A*T*C*A*T*C*C*A*T*C*T |
| 832 | C*A*G*C*T*T*A*C*A*T*C*A*T*C*C*A*T*C*T*G |
| 833 | A*G*C*T*T*A*C*A*T*C*A*T*C*C*A*T*C*T*G*C |
| 834 | G*C*T*T*A*C*A*T*C*A*T*C*C*A*T*C*T*G*C*C |
| 835 | C*T*T*A*C*A*T*C*A*T*C*C*A*T*C*T*G*C*C*T |
| 836 | T*T*A*C*A*T*C*A*T*C*C*A*T*C*T*G*C*C*T*G |
| 837 | T*A*C*A*T*C*A*T*C*C*A*T*C*T*G*C*C*T*G*T |
| 838 | A*C*A*T*C*A*T*C*C*A*T*C*T*G*C*C*T*G*T*T |
| 839 | C*A*T*C*A*T*C*C*A*T*C*T*G*C*C*T*G*T*T*T |
| 840 | A*T*C*A*T*C*C*A*T*C*T*G*C*C*T*G*T*T*T*A |
| 841 | T*C*A*T*C*C*A*T*C*T*G*C*C*T*G*T*T*T*A*T |
| 842 | C*A*T*C*C*A*T*C*T*G*C*C*T*G*T*T*T*A*T*T |
| 843 | A*T*C*C*A*T*C*T*G*C*C*T*G*T*T*T*A*T*T*C |
| 844 | T*C*C*A*T*C*T*G*C*C*T*G*T*T*T*A*T*T*C*A |
| 845 | C*C*A*T*C*T*G*C*C*T*G*T*T*T*A*T*T*C*A*T |
| 846 | C*T*A*C*T*C*T*T*T*T*A*T*C*C*A*T*C*C*A*C |
| 847 | A*C*T*C*T*T*T*T*A*T*C*C*A*T*C*C*A*C*A*C |
| 848 | C*T*C*T*T*T*T*A*T*C*C*A*T*C*C*A*C*A*C*A |
| 849 | T*C*T*T*T*T*A*T*C*C*A*T*C*C*A*C*A*C*A*C |
| 850 | C*T*T*T*T*A*T*C*C*A*T*C*C*A*C*A*C*A*C*C |
| 851 | T*T*T*T*A*T*C*C*A*T*C*C*A*C*A*C*A*C*C*C |
| 852 | T*T*T*A*T*C*C*A*T*C*C*A*C*A*C*A*C*C*C*A |
| 853 | T*T*A*T*C*C*A*T*C*C*A*C*A*C*A*C*C*C*A*C |
| 854 | T*A*T*C*C*A*T*C*C*A*C*A*C*A*C*C*C*A*C*C |
| 855 | +*T*C*C*A*T*C*C*A*C*A*C*A*C*C*C*A*C*C*C |
| 856 | T*C*C*A*T*C*C*A*C*A*C*A*C*C*C*A*C*C*C*A |
| 857 | C*C*A*T*C*C*A*C*A*C*A*C*C*C*A*C*C*C*A*T |
| 858 | C*A*T*C*C*A*C*A*C*A*C*C*C*A*C*C*C*A*T*C |
| 859 | A*T*C*C*A*C*A*C*A*C*C*C*A*C*C*C*A*T*C*T |
| 860 | T*C*C*A*C*A*C*A*C*C*C*A*C*C*C*A*T*C*T*A |
| 861 | C*C*A*C*A*C*A*C*C*C*A*C*C*C*A*T*C*T*A*A |
| 862 | C*A*C*A*C*A*C*C*C*A*C*C*C*A*T*C*T*A*A*C |
| 863 | A*C*A*C*A*C*C*C*A*C*C*C*A*T*C*T*A*A*C*T |
| 864 | C*A*C*A*C*C*C*A*C*C*C*A*T*C*T*A*A*C*T*A |
| 865 | A*C*A*C*C*C*A*C*C*C*A*T*C*T*A*A*C*T*A*C |
| 866 | C*A*C*C*C*A*C*C*C*A*T*C*T*A*A*C*T*A*C*C |
| 867 | A*C*C*C*A*C*C*C*A*T*C*T*A*A*C*T*A*C*C*C |
| 868 | C*C*C*A*C*C*C*A*T*C*T*A*A*C*T*A*C*C*C*C |
| 869 | C*C*A*C*C*C*A*T*C*T*A*A*C*T*A*C*C*C*C*A |
| 870 | C*A*C*C*C*A*T*C*T*A*A*C*T*A*C*C*C*C*A*A |
| 871 | A*C*C*C*A*T*C*T*A*A*C*T*A*C*C*C*C*A*A*A |
| 872 | C*C*C*A*T*C*T*A*A*C*T*A*C*C*C*C*A*A*A*T |
| 873 | C*C*A*T*C*T*A*A*C*T*A*C*C*C*C*A*A*A*T*T |
| 874 | A*A*T*T*C*A*C*C*C*A*T*C*C*A*C*T*C*T*T |
| 875 | A*T*T*T*C*A*C*C*C*A*T*C*C*A*C*T*C*T*T*C |
| 876 | T*T*T*C*A*C*C*C*A*T*C*C*A*C*T*C*T*T*C*C |
| 877 | T*T*C*A*C*C*C*A*T*C*C*A*C*T*C*T*T*C*C*A |
| 878 | T*C*A*C*C*C*A*T*C*C*A*C*T*C*T*T*C*C*A*A |
| 879 | C*A*C*C*C*A*T*C*C*A*C*T*C*T*T*C*C*A*A*C |
| 880 | A*C*C*C*A*T*C*C*A*C*T*C*T*T*C*C*A*A*C*C |
| 881 | C*C*C*A*T*C*C*A*C*T*C*T*T*C*C*A*A*C*C*T |
| 882 | C*C*A*T*C*C*A*C*T*C*T*T*C*C*A*A*C*C*T*T |
| 883 | C*A*T*C*C*A*C*T*C*T*T*C*C*A*A*C*C*T*T*T |
| 884 | A*T*C*C*A*C*T*C*T*T*C*C*A*A*C*C*T*T*T*C |
| 885 | T*C*C*A*C*T*C*T*T*C*C*A*A*C*C*T*T*T*C*A |
| 886 | C*C*A*C*T*C*T*T*C*C*A*A*C*C*T*T*T*C*A*G |
| 887 | C*A*C*T*C*T*T*C*C*A*A*C*C*T*T*T*C*A*G*T |
| 888 | A*C*T*C*T*T*C*C*A*A*C*C*T*T*T*C*A*G*T*A |
| 889 | C*T*C*T*T*C*C*A*A*C*C*T*T*T*C*A*G*T*A*A |
| 890 | C*C*T*T*T*C*A*G*T*A*A*T*T*C*A*A*C*C*A*C |
| 891 | C*A*G*T*A*A*T*T*C*A*A*C*A*C*A*C*A*T*C |
| 892 | A*G*T*A*A*T*T*C*A*A*C*A*C*A*C*A*T*C*C |
| 893 | G*T*A*A*T*T*C*A*A*C*A*C*A*C*A*T*C*C*A |
| 894 | A*A*T*T*C*A*A*C*A*C*A*C*A*T*C*C*A*T*C |
| 895 | A*T*T*C*A*A*C*A*C*A*C*A*T*C*C*A*T*C*C |
| 896 | T*T*C*A*A*C*A*C*A*C*A*T*C*C*A*T*C*C*A |
| 897 | T*C*A*A*C*A*C*A*C*A*T*C*C*A*T*C*C*A*T |
| 898 | C*A*A*C*A*C*A*C*A*T*C*C*A*T*C*C*A*T*C |
| 899 | A*A*C*A*C*A*C*A*T*C*C*A*T*C*C*A*T*C*C |
| 900 | A*C*A*C*A*C*A*T*C*C*A*T*C*C*A*T*C*C*A |
| 901 | C*A*C*A*C*A*T*C*C*A*T*C*C*A*T*C*C*A*T |
| 902 | C*A*C*A*T*C*C*A*T*C*C*A*T*C*C*A*T*C |
| 903 | A*C*A*C*A*T*C*C*A*T*C*C*A*T*C*C*A*T*C*C |
| 904 | C*A*C*A*T*C*C*A*T*C*C*A*T*C*C*A*T*C*C*A |

TABLE 2-continued

| SEQ ID NO. | Sequence |
|---|---|
| 905 | A*C*A*T*C*C*A*T*C*C*A*T*C*C*A*T |
| 906 | Q*A*T*C*C*A*T*C*C*A*T*C*C*A*T*T |
| 907 | A*T*C*C*A*T*C*C*A*T*C*C*A*T*T*C |
| 908 | T*C*C*A*T*C*C*A*T*C*C*A*T*T*C*A |
| 909 | C*C*A*T*C*C*A*T*C*C*A*T*T*C*A*T |
| 910 | Q*A*T*C*C*A*T*C*C*A*T*T*C*A*T*C |
| 911 | A*T*C*C*A*T*C*C*A*T*T*C*A*T*C*C |
| 912 | T*C*C*A*T*C*C*A*T*T*C*A*T*C*C*A |
| 913 | C*C*A*T*C*C*A*T*T*C*A*T*C*C*A*T |
| 914 | C*A*T*C*C*A*T*T*C*A*T*C*C*A*T*C |
| 915 | A*T*C*C*A*T*T*C*A*T*C*C*A*T*C*C |
| 916 | T*C*C*A*T*T*C*A*T*C*C*A*T*C*C*C |
| 917 | C*C*A*T*T*C*A*T*C*C*A*T*C*C*C*A |
| 918 | C*A*T*T*C*A*T*C*C*A*T*C*C*C*A*T |
| 919 | A*T*T*C*A*T*C*C*A*T*C*C*C*A*T*A |
| 920 | T*C*C*A*T*T*C*A*T*C*C*C*A*T*A*C |
| 921 | C*C*A*T*T*C*A*T*C*C*C*A*T*A*C*A |
| 922 | C*A*T*T*C*A*T*C*C*C*A*T*A*C*A*T |
| 923 | T*T*C*A*T*C*C*A*T*C*C*C*A*T*A*T*G |
| 924 | T*C*A*T*C*C*A*T*C*C*C*A*T*A*C*A*T*G*A |
| 925 | C*A*T*C*C*A*T*C*C*C*A*T*A*C*A*T*G*A*T |
| 926 | +*T*C*C*A*T*C*C*C*A*T*A*C*A*T*G*A*T*C |
| 927 | T*C*C*A*T*C*C*C*A*T*A*C*A*T*G*A*T*C*C |
| 928 | G*C*A*A*C*T*T*A*A*T*C*C*A*C*C*T*A*C*C*C |
| 929 | C*A*A*C*T*T*A*A*T*C*C*A*C*C*T*A*C*C*C*A |
| 930 | A*A*C*T*T*A*A*T*C*C*A*C*C*T*A*C*C*C*A*A |
| 931 | A*C*T*T*A*A*T*C*C*A*C*C*T*A*C*C*A*A*T |
| 932 | C*T*T*A*A*T*C*C*A*C*C*T*A*C*C*C*A*A*T*C |
| 933 | T*T*A*A*T*C*C*A*C*C*T*A*C*C*C*A*A*T*C*A |
| 934 | T*A*A*T*C*C*A*C*C*T*A*C*C*C*A*A*T*C*A*T |
| 935 | A*A*T*C*C*A*C*C*T*A*C*C*C*A*A*T*C*A*T*T |
| 936 | A*T*C*C*A*C*C*T*A*C*C*C*A*A*T*C*A*T*T*C |
| 937 | T*C*C*A*C*C*T*A*C*C*C*A*A*T*C*A*T*T*C*A |
| 938 | C*C*A*C*C*T*A*C*C*C*A*A*T*C*A*T*T*C*A*T |
| 939 | C*A*C*C*T*A*C*C*C*A*A*T*C*A*T*T*C*A*T*T |
| 940 | A*C*C*T*A*C*C*C*A*A*T*C*A*T*T*C*A*T*T*C |
| 941 | C*C*T*A*C*C*C*A*A*T*C*A*T*T*C*A*T*T*C*T |
| 942 | C*T*T*T*C*A*T*A*C*A*A*C*C*A*A*C*C*A*T*C |
| 943 | T*T*T*C*A*T*A*C*A*A*C*C*A*A*C*C*A*T*C*C |
| 944 | T*T*C*A*T*A*C*A*A*C*C*A*A*C*C*A*T*C*C*A |
| 945 | T*C*A*T*A*C*A*A*C*C*A*A*C*C*A*T*C*C*A*T |
| 946 | C*A*T*A*C*A*A*C*C*A*A*C*C*A*T*C*C*A*T*C |
| 947 | A*T*A*C*A*A*C*C*A*A*C*C*A*T*C*C*A*T*C*C |
| 948 | T*A*C*A*A*C*C*A*A*C*C*A*T*C*C*A*T*C*C*A |
| 949 | A*C*A*A*C*C*A*A*C*C*A*T*C*C*A*T*C*C*A*C |
| 950 | C*A*A*C*C*A*A*C*C*A*T*C*C*A*T*C*C*A*C*C |
| 951 | A*A*C*C*A*A*C*C*A*T*C*C*A*T*C*C*A*C*C*C |
| 952 | A*C*C*A*A*C*C*A*T*C*C*A*T*C*C*A*C*C*C*A |
| 953 | C*C*A*A*C*C*A*T*C*C*A*T*C*C*A*C*C*C*A*T |
| 954 | C*A*A*C*C*A*T*C*C*A*T*C*C*A*C*C*C*A*T*C |
| 955 | A*A*C*C*A*T*C*C*A*T*C*C*A*C*C*C*A*T*C*A |
| 956 | A*C*C*A*T*C*C*A*T*C*C*A*C*C*C*A*T*C*A*A |
| 957 | C*C*A*T*C*C*A*T*C*C*A*C*C*C*A*T*C*A*A*T |
| 958 | Q*A*T*C*C*A*T*C*C*A*C*C*C*A*T*C*A*A*T*T |
| 959 | A*T*C*C*A*T*C*C*A*C*C*C*A*T*C*A*A*T*T*T |
| 960 | T*C*C*A*T*C*C*A*C*C*C*A*T*C*A*A*T*T*T*A |
| 961 | C*C*A*T*C*C*A*C*C*C*A*T*C*A*A*T*T*T*A*T |
| 962 | Q*A*T*C*C*A*C*C*C*A*T*C*A*A*T*T*T*A*T*C |
| 963 | A*T*C*C*A*C*C*C*A*T*C*A*A*T*T*T*A*T*C*C |
| 964 | T*C*C*A*C*C*C*A*T*C*A*A*T*T*T*A*T*C*C*A |
| 965 | C*C*A*C*C*C*A*T*C*A*A*T*T*T*A*T*C*C*A*A |
| 966 | C*A*C*C*C*A*T*C*A*A*T*T*T*A*T*C*C*A*A*C |
| 967 | A*C*C*C*A*T*C*A*A*T*T*T*A*T*C*C*A*A*C*C |
| 968 | C*C*C*A*T*C*A*A*T*T*T*A*T*C*C*A*A*C*C*A |
| 969 | +*T*C*C*A*C*A*T*C*A*T*T*T*T*T*C*G |
| 970 | T*C*C*A*A*C*C*A*T*C*A*T*T*T*T*T*C*G*T |
| 971 | C*C*A*A*C*C*A*T*C*C*A*T*T*T*T*T*C*G*T*C |
| 972 | C*A*A*C*C*A*T*C*C*A*T*T*T*T*T*C*G*T*C*T |
| 973 | A*A*C*C*A*T*C*C*A*T*T*T*T*T*C*G*T*C*T*G |
| 974 | A*C*C*A*T*C*C*A*T*T*T*T*T*C*G*T*C*T*G*T |
| 975 | C*C*A*T*C*C*A*T*T*T*T*T*C*G*T*C*T*G*T*C |
| 976 | C*A*T*C*C*A*T*T*T*T*T*C*G*T*C*T*G*A*C*C |
| 977 | A*T*C*C*A*T*T*T*T*T*C*G*T*C*T*G*T*C*C*A |
| 978 | T*C*C*A*T*T*T*T*T*C*G*T*C*T*G*T*C*A*C |
| 979 | C*C*A*T*T*T*T*T*C*G*T*C*T*G*T*C*A*C*C |
| 980 | Q*A*T*T*T*T*T*C*G*T*C*T*G*T*C*A*C*C*A |

TABLE 2-continued

| SEQ ID NO. | Sequence |
|---|---|
| 981 | A*T*T*T*T*C*G*T*C*T*G*T*C*C*A*C*C*A*G |
| 982 | T*T*T*T*C*G*T*C*T*G*T*C*C*A*C*C*A*G*C |
| 983 | T*T*T*C*G*T*C*T*G*T*C*C*A*C*C*A*G*C*C |
| 984 | T*T*C*G*T*C*T*G*T*C*C*A*C*C*A*G*C*C*A |
| 985 | T*C*G*T*C*T*G*T*C*C*A*C*C*A*G*C*C*A*C |
| 986 | T*C*G*T*C*T*G*T*C*C*A*C*C*A*G*C*C*A*C*T |
| 987 | G*T*C*T*G*T*C*C*A*C*C*A*G*C*C*A*C*T*C*A |
| 988 | T*C*T*G*T*C*C*A*C*C*A*G*C*C*A*C*T*C*A*C |
| 989 | C*T*G*T*C*C*A*C*C*A*G*C*C*A*C*T*C*A*C*A |
| 990 | T*G*T*C*C*A*C*C*A*G*C*C*A*C*T*C*A*C*A*A |
| 991 | G*T*C*C*A*C*C*A*G*C*C*A*C*T*C*A*C*A*A*C |
| 992 | T*C*C*A*C*C*A*G*C*C*A*C*T*C*A*C*A*A*C*C |
| 993 | C*C*A*C*C*A*G*C*C*A*C*T*C*A*C*A*A*C*C*A |
| 994 | C*A*C*C*A*G*C*C*A*C*T*C*A*C*A*A*C*C*A*T |
| 995 | A*C*C*A*G*C*C*A*C*T*C*A*C*A*A*C*C*A*T*C |
| 996 | C*C*A*G*C*C*A*C*T*C*A*C*A*A*C*C*A*T*C*C |
| 997 | C*A*G*C*C*A*C*T*C*A*C*A*A*C*C*A*T*C*C*A |
| 998 | A*G*C*C*A*C*T*C*A*C*A*A*C*C*A*T*C*C*A*T |
| 999 | G*C*C*A*C*T*C*A*C*A*A*C*C*A*T*C*C*A*T*C |
| 1000 | C*C*A*C*T*C*A*C*A*A*C*C*A*T*C*C*A*T*C*T |
| 1001 | C*A*C*T*C*A*C*A*A*C*C*A*T*C*C*A*T*C*T*A |
| 1002 | A*C*T*C*A*C*A*A*C*C*A*T*C*C*A*T*C*T*A*A |
| 1003 | C*T*C*A*C*A*A*C*C*A*T*C*C*A*T*C*T*A*A*A |
| 1004 | G*C*A*A*T*A*G*T*T*C*A*A*C*C*A*C*A*C*A*T |
| 1005 | C*A*A*T*A*G*T*T*C*A*A*C*C*A*C*A*C*A*T*C |
| 1006 | A*A*T*A*G*T*T*C*A*A*C*C*A*C*A*C*A*T*C*C |
| 1007 | A*T*A*G*T*T*C*A*A*C*C*A*C*A*C*A*T*C*C*T |
| 1008 | T*A*G*T*T*C*A*A*C*C*A*C*A*C*A*T*C*C*T*T |
| 1009 | A*G*T*T*C*A*A*C*C*A*C*A*C*A*T*C*C*T*T*C |
| 1010 | G*T*T*C*A*A*C*C*A*C*A*C*A*T*C*C*T*T*C*C |
| 1011 | T*T*C*A*A*C*C*A*C*A*C*A*T*C*C*T*T*C*C*A |
| 1012 | T*C*A*A*C*C*A*C*A*C*A*T*C*C*T*T*C*C*A*T |
| 1013 | C*A*A*C*C*A*C*A*C*A*T*C*C*T*T*C*C*A*T*T |
| 1014 | A*A*C*C*A*C*A*C*A*T*C*C*T*T*C*C*A*T*T*C |
| 1015 | A*C*C*A*C*A*C*A*T*C*C*T*T*C*C*A*T*T*C*A |
| 1016 | C*C*A*C*A*C*A*T*C*C*T*T*C*C*A*T*T*C*A*T |
| 1017 | C*A*C*A*C*A*T*C*C*T*T*C*C*A*T*T*C*A*T*C |
| 1018 | A*C*A*C*A*T*C*C*T*T*C*C*A*T*T*C*A*T*C*C |

| SEQ ID NO. | Sequence |
|---|---|
| 1019 | C*A*C*A*T*C*C*T*T*C*C*A*T*T*C*A*T*C*C*A |
| 1020 | A*C*A*T*C*C*T*T*C*C*A*T*T*C*A*T*C*C*A*C |
| 1021 | C*A*T*C*C*T*T*C*C*A*T*T*C*A*T*C*C*A*C*C |
| 1022 | A*T*C*C*T*T*C*C*A*T*T*C*A*T*C*C*A*C*C*C |
| 1023 | T*C*C*T*T*C*C*A*T*T*C*A*T*C*C*A*C*C*C*A |
| 1024 | Q*Q*T*T*C*C*A*T*T*C*A*T*C*C*A*C*C*C*A*C |
| 1025 | C*T*T*C*C*A*T*T*C*A*T*C*C*A*C*C*C*A*C*C |
| 1026 | T*T*C*C*A*T*T*C*A*T*C*C*A*C*C*C*A*C*C*C |
| 1027 | T*C*C*A*T*T*C*A*T*C*C*A*C*C*C*A*C*C*C*A |
| 1028 | C*C*A*T*T*C*A*T*C*C*A*C*C*C*A*C*C*C*A*T |
| 1029 | C*A*T*T*C*A*T*C*C*A*C*C*C*A*C*C*C*A*T*T |
| 1030 | A*T*T*C*A*T*C*C*A*C*C*C*A*C*C*C*A*T*T*C |
| 1031 | T*T*C*A*T*C*C*A*C*C*C*A*C*C*C*A*T*T*C*A |
| 1032 | T*C*A*T*C*C*A*C*C*C*A*C*C*C*A*T*T*C*A*T |
| 1033 | C*A*T*C*C*A*C*C*C*A*C*C*C*A*T*T*C*A*T*C |
| 1034 | +*T*C*C*A*C*C*C*A*C*C*C*A*T*T*C*A*T*C*C |
| 1035 | T*C*C*A*C*C*C*A*C*C*C*A*T*T*C*A*T*C*C*A |
| 1036 | C*C*A*C*C*C*A*C*C*C*A*T*T*C*A*T*C*C*A*T |
| 1037 | C*A*C*C*C*A*C*C*C*A*T*T*C*A*T*C*C*A*T*T |
| 1038 | A*C*C*C*A*C*C*C*A*T*T*C*A*T*C*C*A*T*T*T |
| 1039 | C*C*C*A*C*C*C*A*T*T*C*A*T*C*C*A*T*T*T*G |
| 1040 | C*C*A*C*C*C*A*T*T*C*A*T*C*C*A*T*T*T*G*T |
| 1041 | C*A*C*C*C*A*T*T*C*A*T*C*C*A*T*T*T*G*T*C |
| 1042 | A*C*C*C*A*T*T*C*A*T*C*C*A*T*T*T*G*T*C*C |
| 1043 | C*C*C*A*T*T*C*A*T*C*C*A*T*T*T*G*T*C*C*A*T |
| 1044 | C*C*A*T*T*C*A*T*C*C*A*T*T*T*G*T*C*C*A*T*C |
| 1045 | T*T*C*A*T*C*C*A*T*T*T*G*T*C*C*A*T*C*T*G |
| 1046 | T*C*A*T*C*C*A*T*T*T*G*T*C*C*A*T*C*T*G*C |
| 1047 | C*A*T*C*C*A*T*T*T*G*T*C*C*A*T*C*A*G*C*C |
| 1048 | A*T*C*C*A*T*T*T*G*T*C*C*A*T*C*T*G*C*C*T |
| 1049 | T*C*C*A*T*T*T*G*T*C*C*A*T*C*T*G*C*C*T*A |
| 1050 | C*C*A*T*T*T*G*T*C*C*A*T*C*T*G*C*C*T*A*T |
| 1051 | C*A*T*T*T*G*T*C*C*A*T*C*T*G*C*C*T*A*T*A |
| 1052 | A*T*T*T*G*T*C*C*A*T*C*T*G*C*C*T*A*T*A*C |
| 1053 | T*T*T*G*T*C*C*A*T*C*T*G*C*C*T*A*T*A*C*A |
| 1054 | T*T*G*T*C*C*A*T*C*T*G*C*C*T*A*T*A*C*A*T |
| 1055 | T*G*T*C*C*A*T*C*T*G*C*C*T*A*T*A*C*A*T*C |
| 1056 | G*T*C*C*A*T*C*T*G*C*C*T*A*T*A*C*A*T*C*C |
| | T*C*C*A*T*C*T*G*C*C*T*A*T*A*C*A*T*C*C*A |

TABLE 2-continued

| SEQ ID NO. | Sequence |
|---|---|
| 1057 | C*C*A*T*C*T*G*C*C*T*A*T*A*C*A*T*C*C*A*T |
| 1058 | C*A*T*C*T*G*C*C*T*A*T*A*C*A*T*C*C*A*T*C |
| 1059 | A*T*C*T*G*C*C*T*A*T*A*C*A*T*C*C*A*T*C*C |
| 1060 | T*C*T*G*C*C*T*A*T*A*C*A*T*C*C*A*T*C*C*A |
| 1061 | C*A*G*C*C*T*A*T*A*C*A*T*C*C*A*T*C*C*A*T |
| 1062 | T*G*C*C*T*A*T*A*C*A*T*C*C*A*T*C*C*A*T*C |
| 1063 | G*C*C*T*A*T*A*C*A*T*C*C*A*T*C*C*A*T*C*C |
| 1064 | C*C*T*A*T*A*C*A*T*C*C*A*T*C*C*A*T*C*C*A |
| 1065 | C*T*A*T*A*C*A*T*C*C*A*T*C*C*A*T*C*C*A*T |
| 1066 | T*A*T*A*C*A*T*C*C*A*T*C*C*A*T*C*C*A*T*C |
| 1067 | +*T*A*C*A*T*C*C*A*T*C*C*A*T*C*C*A*T*C*C |
| 1068 | T*A*C*A*T*C*C*A*T*C*C*A*T*C*C*A*T*C*C*A |
| 1069 | A*C*A*T*C*C*A*T*C*C*A*T*C*C*A*T*C*C*A*T |
| 1070 | C*A*T*C*C*A*T*C*C*A*T*C*C*A*T*C*C*A*T*C |
| 1071 | +*T*C*C*A*T*C*C*A*T*C*C*A*T*C*C*A*T*C*C |
| 1072 | T*C*C*A*T*C*C*A*T*C*C*A*T*C*C*A*T*C*C*A |
| 1073 | C*C*A*T*C*C*A*T*C*C*A*T*C*C*A*T*C*C*A*T |
| 1074 | C*A*T*C*C*A*T*C*C*A*T*C*C*A*T*C*C*A*T*C |
| 1075 | A*T*C*C*A*T*C*C*A*T*C*C*A*T*C*C*A*T*C*T |
| 1076 | T*C*C*A*T*C*C*A*T*C*C*A*T*C*C*A*T*C*T*A |
| 1077 | C*C*A*T*C*C*A*T*C*C*A*T*C*C*A*T*C*T*A*C |
| 1078 | C*A*T*C*C*A*T*C*C*A*T*C*C*A*T*C*T*A*C*C |
| 1079 | +*T*C*C*A*T*C*C*A*T*C*C*A*T*C*T*A*C*C*T |
| 1080 | T*C*C*A*T*C*C*A*T*C*C*A*T*C*T*A*C*C*T*A |
| 1081 | C*C*A*T*C*C*A*T*C*C*A*T*C*T*A*C*C*T*A*T |
| 1082 | C*A*T*C*C*A*T*C*C*A*T*C*T*A*C*C*T*A*T*C |
| 1083 | +*T*C*C*A*T*C*C*A*T*C*T*A*C*C*T*A*T*C*T |
| 1084 | T*C*C*A*T*C*C*A*T*C*T*A*C*C*T*A*T*C*T*A |
| 1085 | C*C*A*T*C*C*A*T*C*T*A*C*C*T*A*T*C*T*A*C |
| 1086 | C*A*T*C*C*A*T*C*T*A*C*C*T*A*T*C*T*A*C*C |
| 1087 | +*T*C*C*A*T*C*T*A*C*C*T*A*T*C*T*A*C*C*C |
| 1088 | T*C*C*A*T*C*T*A*C*C*T*A*T*C*T*A*C*C*C*A |
| 1089 | C*C*A*T*C*T*A*C*C*T*A*T*C*T*A*C*C*C*A*T |
| 1090 | C*A*T*C*T*A*C*C*T*A*T*C*T*A*C*C*C*A*T*C |
| 1091 | +*T*C*T*A*C*C*T*A*T*C*T*A*C*C*C*A*T*C*T |
| 1092 | T*C*T*A*C*C*T*A*T*C*T*A*C*C*C*A*T*C*T*G |
| 1093 | C*T*A*C*C*T*A*T*C*T*A*C*C*C*A*T*C*T*G*A |
| 1094 | T*A*C*C*T*A*T*C*T*A*C*C*C*A*T*C*T*G*A*C |
| 1095 | A*C*C*T*A*T*C*T*A*C*C*C*A*T*C*T*G*A*C*T |
| 1096 | C*C*T*A*T*C*T*A*C*C*C*A*T*C*T*G*A*C*T*A |
| 1097 | C*T*A*T*C*T*A*C*C*C*A*T*C*T*G*A*C*T*A*T |
| 1098 | T*A*T*C*T*A*C*C*C*A*T*C*T*G*A*C*T*A*T*C |
| 1099 | A*T*C*T*A*C*C*C*A*T*C*T*G*A*C*T*A*T*C*A |
| 1100 | T*C*T*A*C*C*C*A*T*C*T*G*A*C*T*A*T*C*A*A |
| 1101 | C*T*A*C*C*C*A*T*C*T*G*A*C*T*A*T*C*A*A*C |
| 1102 | T*A*C*C*C*A*T*C*T*G*A*C*T*A*T*C*A*A*C*A |
| 1103 | A*C*C*C*A*T*C*T*G*A*C*T*A*T*C*A*A*C*A*A |
| 1104 | C*C*C*A*T*C*T*G*A*C*T*A*T*C*A*A*C*A*A*A |
| 1105 | C*A*C*T*A*T*C*T*A*C*T*C*A*A*T*C*T*T*C |
| 1106 | A*C*T*A*T*C*T*A*C*T*C*A*A*T*C*T*T*C*C |
| 1107 | C*C*T*A*T*C*T*A*C*T*C*A*A*T*C*T*T*C*C*T |
| 1108 | C*C*T*T*C*T*A*A*T*A*A*C*T*C*A*A*C*A*C |
| 1109 | A*A*T*A*A*C*T*C*A*A*C*A*C*A*C*T*T*C*C |
| 1110 | A*T*A*A*C*T*C*A*A*C*A*C*A*C*A*C*T*T*C*C*A |
| 1111 | T*A*A*C*T*C*A*A*C*A*C*A*C*A*C*T*T*C*A*T |
| 1112 | A*A*C*T*C*A*A*C*A*C*A*C*A*C*T*T*C*A*T*C |
| 1113 | A*C*T*C*A*A*C*A*C*A*C*A*C*T*T*C*A*T*C*C |
| 1114 | C*T*C*A*A*C*A*C*A*C*A*C*T*T*C*C*A*T*C*C*A |
| 1115 | T*C*A*A*C*A*C*A*C*A*C*T*T*C*C*A*T*C*C*A*T |
| 1116 | C*A*A*C*A*C*A*C*A*C*T*T*C*C*A*T*C*C*A*T*C |
| 1117 | A*A*C*A*C*A*C*A*C*T*T*C*C*A*T*C*C*A*T*C*C |
| 1118 | A*C*A*C*A*C*A*C*T*T*C*C*A*T*C*C*A*T*C*C*C |
| 1119 | C*C*A*C*A*C*T*T*C*C*A*T*C*C*A*T*C*C*C*A |
| 1120 | C*A*C*A*C*T*T*C*C*A*T*C*C*A*T*C*C*C*A*T |
| 1121 | A*C*A*C*T*T*C*C*A*T*C*C*A*T*C*C*C*A*T*C |
| 1122 | C*A*C*T*T*C*C*A*T*C*C*A*T*C*C*C*A*T*C*C |
| 1123 | A*C*T*T*C*C*A*T*C*C*A*T*C*C*C*A*T*C*C*A |
| 1124 | C*T*T*C*C*A*T*C*C*A*T*C*C*C*A*T*C*C*A*A |
| 1125 | T*T*C*C*A*T*C*C*A*T*C*C*C*A*T*C*C*A*A*T |
| 1126 | T*C*C*A*T*C*C*A*T*C*C*C*A*T*C*C*A*A*T*A |
| 1127 | C*C*A*T*C*C*A*T*C*C*C*A*T*C*C*A*A*T*A*C |
| 1128 | Q*A*T*C*C*A*T*C*C*C*A*T*C*C*A*A*T*A*C*A |
| 1129 | A*T*C*C*A*T*C*C*C*A*T*C*C*A*A*T*A*C*A*A |
| 1130 | T*C*C*A*T*C*C*C*A*T*C*C*A*A*T*A*C*A*A*C |
| 1131 | C*C*A*T*C*C*C*A*T*C*C*A*A*T*A*C*A*A*C*T |
| 1132 | C*A*T*C*C*C*A*T*C*C*A*A*T*A*C*A*A*C*T*T |

TABLE 2-continued

| SEQ ID NO. | Sequence |
|---|---|
| 1133 | A*C*A*A*C*T*T*A*A*T*C*T*G*C*T*C*A*T*C*C |
| 1134 | C*A*A*C*T*T*A*A*T*C*T*G*C*T*C*A*T*C*C*A |
| 1135 | A*C*T*T*A*A*T*C*T*G*C*T*C*A*T*C*C*A*A*C |
| 1136 | C*T*T*A*A*T*C*T*G*C*T*C*A*T*C*C*A*A*C*A |
| 1137 | A*T*C*T*G*C*T*C*A*T*C*C*A*A*C*A*T*T*T*C |
| 1138 | T*C*T*G*C*T*C*A*T*C*C*A*A*C*A*T*T*T*C*A |
| 1139 | C*T*G*C*T*C*A*T*C*C*A*A*C*A*T*T*T*C*A*T |
| 1140 | T*G*C*T*C*A*T*C*C*A*A*C*A*T*T*T*C*A*T*C |
| 1141 | G*C*T*C*A*T*C*C*A*A*C*A*T*T*T*C*A*T*C*T |
| 1142 | C*C*A*A*C*A*T*T*T*C*A*T*C*T*A*T*C*C*A*C |
| 1143 | C*A*A*C*A*T*T*T*C*A*T*C*T*A*T*C*C*A*C*C |
| 1144 | A*A*C*A*T*T*T*C*A*T*C*T*A*T*C*C*A*C*C*C |
| 1145 | A*C*A*T*T*T*C*A*T*C*T*A*T*C*C*A*C*C*C*A |
| 1146 | C*A*T*T*T*C*A*T*C*T*A*T*C*C*A*C*C*C*A*G |
| 1147 | A*T*T*T*C*A*T*C*T*A*T*C*C*A*C*C*C*A*G*T |
| 1148 | T*T*T*C*A*T*C*T*A*T*C*C*A*C*C*C*A*G*T*C |
| 1149 | T*T*C*A*T*C*T*A*T*C*C*A*C*C*C*A*G*T*C*A |
| 1150 | T*C*A*T*C*T*A*T*C*C*A*C*C*C*A*G*T*C*A*A |
| 1151 | C*A*T*C*T*A*T*C*C*A*C*C*C*A*G*T*C*A*A*T |
| 1152 | A*T*C*T*A*T*C*C*A*C*C*C*A*G*T*C*A*A*T*C |
| 1153 | T*C*T*A*T*C*C*A*C*C*C*A*G*T*C*A*A*T*C*A |
| 1154 | C*T*A*T*C*C*A*C*C*C*A*G*T*C*A*A*T*C*A*T |
| 1155 | T*A*T*C*C*A*C*C*C*A*G*T*C*A*A*T*C*A*T*C |
| 1156 | A*T*C*C*A*C*C*C*A*G*T*C*A*A*T*C*A*T*C*T |
| 1157 | T*C*C*A*C*C*C*A*G*T*C*A*A*T*C*A*T*C*T*A |
| 1158 | C*C*A*C*C*C*A*G*T*C*A*A*T*C*A*T*C*T*A*T |
| 1159 | C*A*C*C*C*A*G*T*C*A*A*T*C*A*T*C*T*A*T*C |
| 1160 | A*C*C*C*A*G*T*C*A*A*T*C*A*T*C*T*A*T*C*C |
| 1161 | C*C*C*A*G*T*C*A*A*T*C*A*T*C*T*A*T*C*C*A |
| 1162 | C*C*A*G*T*C*A*A*T*C*A*T*C*T*A*T*C*C*A*G |
| 1163 | C*A*G*T*C*A*A*T*C*A*T*C*T*A*T*C*C*A*G*C |
| 1164 | A*G*T*C*A*A*T*C*A*T*C*T*A*T*C*C*A*G*C*A |
| 1165 | G*T*C*A*A*T*C*A*T*C*T*A*T*C*C*A*G*C*A*A |
| 1166 | C*A*A*T*C*A*T*C*T*A*T*C*C*A*G*C*A*A*T*C |
| 1167 | C*A*T*C*T*A*T*C*C*A*G*C*A*A*T*C*T*A*T*C |
| 1168 | A*T*C*T*A*G*C*A*A*T*C*T*A*T*C*T*A*T*C*C |
| 1169 | T*C*C*A*G*C*A*A*T*C*T*A*T*C*T*A*T*C*C*A |
| 1170 | C*C*A*G*C*A*A*T*C*T*A*T*C*T*A*T*C*C*A*C |
| 1171 | C*A*G*C*A*A*T*C*T*A*T*C*T*A*T*C*C*A*C*T |
| 1172 | A*G*C*A*A*T*C*T*A*T*C*T*A*T*C*C*A*C*T*C |
| 1173 | G*C*A*A*T*C*T*A*T*C*T*A*T*C*C*A*C*T*C*A |
| 1174 | C*T*A*T*C*T*A*T*C*C*A*C*T*C*A*T*C*A*A*G |
| 1175 | A*T*C*A*C*T*C*A*T*C*A*A*G*T*T*A*T*C*C |
| 1176 | T*C*C*A*C*T*C*A*T*C*A*A*G*T*T*A*T*C*C*A |
| 1177 | C*C*A*C*T*C*A*T*C*A*A*G*T*T*A*T*C*C*A*T |
| 1178 | C*A*C*T*C*A*T*C*A*A*G*T*T*A*T*C*C*A*T*C |
| 1179 | A*C*T*C*A*T*C*A*A*G*T*T*A*T*C*C*A*T*C*C |
| 1180 | C*T*C*A*T*C*A*A*G*T*T*A*T*C*C*A*T*C*C*A |
| 1181 | C*A*T*C*A*A*G*T*T*A*T*C*C*A*T*C*C*A*T*C |
| 1182 | C*C*A*T*C*A*T*C*T*A*A*C*A*A*T*T*A*C*C*C |
| 1183 | C*A*T*C*A*T*C*T*A*A*C*A*A*T*T*A*C*C*C*C |
| 1184 | A*T*C*A*T*C*T*A*A*C*A*A*T*T*A*C*C*C*C*C |
| 1185 | T*C*A*T*C*T*A*A*C*A*A*T*T*A*C*C*C*C*C*A |
| 1186 | C*A*T*C*T*A*A*C*A*A*T*T*A*C*C*C*C*C*A*A |
| 1187 | A*C*A*A*T*T*A*C*C*C*C*C*A*A*A*T*T*C*A*C |
| 1188 | C*A*A*T*T*A*C*C*C*C*C*A*A*A*T*T*C*A*C*C |
| 1189 | C*C*A*T*C*C*C*A*T*A*A*T*T*G*A*T*C*C*G |
| 1190 | C*A*T*C*C*C*A*T*A*A*C*A*T*T*G*A*T*C*C*G*C |
| 1191 | A*T*C*C*C*A*T*A*A*C*A*T*T*G*A*T*C*C*G*C*A |
| 1192 | T*C*C*C*A*T*A*C*A*T*T*G*A*T*C*C*G*C*A*A |
| 1193 | C*C*C*A*T*A*C*A*T*T*G*A*T*C*C*G*C*A*A*C |
| 1194 | C*C*A*T*A*C*A*T*T*G*A*T*C*C*G*C*A*A*C*T |
| 1195 | C*A*T*A*C*A*T*T*G*A*T*C*C*G*C*A*A*C*T*T |
| 1196 | C*A*T*T*G*A*T*C*C*G*C*A*A*C*T*T*A*A*T*C |
| 1197 | A*T*T*G*A*T*C*C*G*C*A*A*C*T*T*A*A*T*C*C |
| 1198 | T*T*G*A*T*C*C*G*C*A*A*C*T*T*A*A*T*C*C*A |
| 1199 | T*G*A*T*C*C*G*C*A*A*C*T*T*A*A*T*C*C*A*C |
| 1200 | G*A*A*C*C*G*C*A*A*C*T*T*A*A*T*C*C*A*C*C |
| 1201 | A*T*C*G*C*A*A*C*T*T*A*A*T*C*C*A*C*C*T |
| 1202 | T*C*G*C*A*A*C*T*T*A*A*T*C*C*A*C*A*C*T*A |
| 1203 | C*G*C*A*A*C*T*T*A*A*T*C*C*A*C*A*C*T*A*C |
| 1204 | C*G*C*A*A*C*T*T*A*A*T*C*C*A*C*C*T*A*C*C |
| 1205 | C*A*T*T*C*A*T*C*C*A*C*C*C*A*C*C*C*A*T |
| 1206 | C*C*C*A*T*T*C*A*T*C*C*A*T*T*T*G*T*C*A |
| 1207 | C*C*A*T*C*A*T*C*C*A*T*C*T*A*G*C*A*C*G |
| 1208 | C*A*T*C*A*T*C*C*A*T*C*T*A*G*C*A*C*G*A |

TABLE 2-continued

| SEQ ID NO. | Sequence |
|---|---|
| 1209 | A*T*C*A*T*C*C*A*T*C*T*A*G*C*C*A*C*G*A*A |
| 1210 | T*C*A*T*C*C*A*T*C*T*A*G*C*C*A*C*G*A*A*T |
| 1211 | C*A*T*C*C*A*T*C*T*A*G*C*C*A*C*G*A*A*T*C |
| 1212 | A*T*C*C*A*T*C*T*A*G*C*C*A*C*G*A*A*T*C*T |
| 1213 | T*C*C*A*T*C*T*A*G*C*C*A*C*G*A*A*T*C*T*A |
| 1214 | C*C*A*T*C*T*A*G*C*C*A*C*G*A*A*T*C*T*A*C |
| 1215 | C*A*T*C*T*A*G*C*C*A*C*G*A*A*T*C*T*A*C*C |
| 1216 | A*T*C*T*A*G*C*C*A*C*G*A*A*T*C*T*A*C*C*C |
| 1217 | T*C*T*A*G*C*C*A*C*G*A*A*T*C*T*A*C*C*C*A |
| 1218 | C*T*A*G*C*C*A*C*G*A*A*T*C*T*A*C*C*C*A*C |
| 1219 | T*A*G*C*C*A*C*G*A*A*T*C*T*A*C*C*C*A*C*C |
| 1220 | A*G*C*C*A*C*G*A*A*T*C*T*A*C*C*C*A*C*C*A |
| 1221 | G*C*C*A*C*G*A*A*T*C*T*A*C*C*C*A*C*C*A*A |
| 1222 | C*C*A*C*G*A*A*T*C*T*A*C*C*C*A*C*C*A*A*C |
| 1223 | C*A*C*G*A*A*T*C*T*A*C*C*C*A*C*C*A*A*C*T |
| 1224 | A*C*G*A*A*T*C*T*A*C*C*C*A*C*C*A*A*C*T*C |
| 1225 | C*G*A*A*T*C*T*A*C*C*C*A*C*C*A*A*C*T*C*A |
| 1226 | G*A*C*A*T*A*C*C*C*A*G*A*C*A*C*A*A*A*C*G |
| 1227 | A*C*A*T*A*C*C*C*A*G*A*C*A*C*A*A*A*C*G*G |
| 1228 | C*A*T*A*C*C*C*A*G*A*C*A*C*A*A*A*C*G*G*C |
| 1229 | G*C*C*A*G*A*A*A*G*A*G*G*A*A*G*A*G*C*T*G |
| 1230 | C*C*A*G*A*A*A*G*A*G*G*A*A*G*A*G*C*T*G*G |
| 1231 | G*G*C*A*G*G*C*A*G*G*A*A*T*G*G*T*G*A*G*T |
| 1232 | G*C*A*G*G*C*A*G*G*A*A*T*G*G*T*G*A*G*T*G |
| 1233 | C*A*G*G*C*A*G*G*A*A*T*G*G*T*G*A*G*T*G*G |
| 1234 | A*G*G*C*A*G*G*A*A*A*G*G*A*G*A*G*A*G*G*A |
| 1235 | G*G*C*A*G*G*A*A*A*G*G*A*G*A*G*A*C*G*A*A |
| 1236 | G*C*A*G*G*A*A*A*A*G*G*A*G*A*G*A*G*G*A*A*G |
| 1237 | C*A*C*G*A*A*A*G*G*T*G*A*G*A*G*G*A*A*G*T |
| 1238 | A*C*G*A*A*A*G*G*A*G*A*G*A*G*G*A*A*G*A*G |
| 1239 | C*G*A*A*T*G*G*A*G*A*G*A*G*G*A*A*G*A*G*G |
| 1240 | G*A*A*A*G*G*A*G*A*G*A*G*G*A*A*G*A*G*G*C |
| 1241 | A*A*A*G*G*A*G*A*G*A*G*G*A*A*G*A*G*G*C*A |
| 1242 | A*A*G*G*T*G*A*G*A*G*A*A*G*A*G*G*C*A*T |
| 1243 | T*G*G*T*G*A*G*A*G*A*A*G*A*G*G*C*A*T*G |
| 1244 | G*A*G*A*G*A*G*G*A*A*G*A*G*G*C*A*T*G*G |
| 1245 | T*C*A*T*T*C*A*T*C*T*G*T |
| 1246 | C*T*C*A*T*T*C*A*T*C*T*G |

| SEQ ID NO. | Sequence |
|---|---|
| 1247 | A*C*T*C*A*T*T*C*A*T*C*T |
| 1248 | C*A*C*T*C*A*T*T*C*A*T*C |
| 1249 | T*C*A*C*T*C*A*T*T*C*A*T |
| 1250 | A*T*C*A*C*T*C*A*T*T*C*A |
| 1251 | C*A*T*C*A*C*T*C*A*T*T*C |
| 1252 | T*C*A*T*C*A*C*T*C*A*T*T |
| 1253 | C*T*C*A*T*C*A*C*T*C*A*T |
| 1254 | C*A*C*T*C*A*T*T*C*A*T*C*T*G*T |
| 1255 | T*C*A*C*T*C*A*T*T*C*A*T*C*T*G |
| 1256 | A*T*C*A*C*T*C*A*T*T*C*A*T*C*T |
| 1257 | C*A*T*C*A*C*T*C*A*T*T*C*A*T*C |
| 1258 | T*C*A*TC*A*C*T*C*A*T*T*C*A*T |
| 1259 | C*T*C*A*T*C*A*C*T*C*A*T*T*C*A |
| 1260 | T*C*A*C*T*C*A*T*T*C*A*T*C*T*G*T |
| 1261 | A*T*C*A*C*T*C*A*T*T*C*A*T*C*T*G |
| 1262 | C*A*T*C*A*C*T*C*A*T*T*C*A*T*C*T |
| 1263 | T*C*A*T*C*A*C*T*C*A*T*T*C*A*T*C |
| 1264 | C*T*C*A*T*C*A*C*T*C*A*T*T*C*A*T |
| 1265 | A*T*C*A*C*T*C*A*T*T*C*A*T*C*T*G*T |
| 1266 | C*A*T*C*A*C*T*C*A*T*T*C*A*T*C*T*G |
| 1267 | T*C*A*T*C*A*C*T*C*A*T*T*C*A*T*C*T |
| 1268 | C*T*C*A*T*C*A*C*T*C*A*T*T*C*A*T*C |
| 1269 | C*A*T*C*A*C*T*C*A*T*T*C*A*T*C*T*G*T |
| 1270 | T*C*A*T*C*A*C*T*C*A*T*T*C*A*T*C*T*G |
| 1271 | C*T*C*A*T*C*A*C*T*C*A*T*T*C*A*T*C*T |
| 1272 | T*C*A*T*C*A*C*T*C*A*T*T*C*A*T*C*T*G*T |
| 1273 | C*T*C*A*T*C*A*C*T*C*A*T*T*C*A*T*C*T*G |
| 1274 | C*T*C*A*T*C*A*C*T*C*A*T*T*C*A*T*C*T*G*T*T |
| 1275 | A*C*T*C*A*T*C*A*C*T*C*A*T*T*C*A*T*C*T*G*T |
| 1276 | C*T*C*A*T*C*A*C*T*C*A*T*T*C*A*T*C*T*G*T*T*C |
| 1277 | A*C*T*C*A*T*C*A*C*T*C*A*T*T*C*A*T*C*T*G*T*T |
| 1278 | T*A*C*T*C*A*T*C*A*C*T*C*A*T*T*C*A*T*C*T*G*T |
| 1279 | C*T*C*A*T*C*A*C*T*C*A*T*T*C*A*T*C*T*G*T*T*C*A |
| 1280 | A*C*T*C*A*T*C*A*C*T*C*A*T*T*C*A*T*C*T*G*T*T*C |

TABLE 2-continued

| SEQ ID NO. | Sequence |
|---|---|
| 1281 | T*A*C*T*C*A*T*C*A*C*T*C*A*T*T*C*A*T*C*T*G*T*T |
| 1282 | C*T*A*C*T*C*A*T*C*A*C*T*C*A*T*T*C*A*T*C*T*G*T |

ASO 55 (SEQ ID. NO. 55) variations with a motif where each nucleobase has a 2'-OCH$_2$CH$_2$—OCH$_3$ group (i.e., 2'-MOE) and each internucleoside linkage is a phosphorothioate linkage are alternately labeled as below, to be more clearly identifiable as variations of ASO 55 with the aforementioned motif and internucleoside linkage:

| SEQ ID NO. | Alternate Identifier |
|---|---|
| 1245 | hUNC13A-ASO55_12-1 |
| 1246 | hUNC13A-ASO55_12-2 |
| 1247 | hUNC13A-ASO55_12-3 |
| 1248 | hUNC13A-ASO55_12-4 |
| 1249 | hUNC13A-ASO55_12-5 |
| 1250 | hUNC13A-ASO55_12-6 |
| 1251 | hUNC13A-ASO55_12-7 |
| 1252 | hUNC13A-ASO55_12-8 |
| 1253 | hUNC13A-ASO55_12-9 |
| 1254 | hUNC13A-ASO55_15-1 |
| 1255 | hUNC13A-ASO55_15-2 |
| 1256 | hUNC13A-ASO55_15-3 |
| 1257 | hUNC13A-ASO55_15-4 |
| 1258 | hUNC13A-ASO55_15-5 |
| 1259 | hUNC13A-ASO55_15-6 |
| 1260 | hUNC13A-ASO55_16-1 |
| 1261 | hUNC13A-ASO55_16-2 |
| 1262 | hUNC13A-ASO55_16-3 |
| 1263 | hUNC13A-ASO55_16-4 |
| 1264 | hUNC13A-ASO55_16-5 |
| 1265 | hUNC13A-ASO55_17-1 |
| 1266 | hUNC13A-ASO55_17-2 |
| 1267 | hUNC13A-ASO55_17-3 |
| 1268 | hUNC13A-ASO55_17-4 |
| 1269 | hUNC13A-ASO55_18-1 |
| 1270 | hUNC13A-ASO55_18-2 |
| 1271 | hUNC13A-ASO55_18-3 |
| 1272 | hUNC13A-ASO55_19-1 |
| 1273 | hUNC13A-ASO55_19-2 |
| 1274 | hUNC13A-ASO55_21-1 |
| 1275 | hUNC13A-ASO55_21-2 |
| 1276 | hUNC13A-ASO55_22-1 |
| 1277 | hUNC13A-ASO55_22-2 |
| 1278 | hUNC13A-ASO55_22-3 |
| 1279 | hUNC13A-ASO55_23-1 |
| 1280 | hUNC13A-ASO55_23-2 |
| 1281 | hUNC13A-ASO55_23-3 |
| 1282 | hUNC13A-ASO55_23-4 |

The UNC13A antisense or inhibitory nucleic acids of the disclosure can inhibit the expression of the cryptic exon between canonical exons 20 and 21 of UNC13A and increase UNC13 protein expression. The UNC13A antisense or inhibitory nucleic acids can include any combination of the oligonucleotides set forth in Table 2 and sequences that are 98%-99% identical thereto.

In one embodiment, the ASO or oligonucleotide is 100% complementary to SEQ ID NO: 1283 (chr19:17641557-17642844).

| SEQ ID NO: 1283 | GUGAGGGUCA UUGCUCGGCC CCUCCCAUGC CACUUCCACU CACCAUUCCU GCCUGCCCAG |
|---|---|

CUCUUCCUCU UUCUGGCCAC ACCAUCCACA
CUCUCCUGGC CCUCUGAGAC UGCCCGCCAU
GCCAUUCCCU UUACCUGGAA AACUCCUCCC
UAUCCAUCAA AGUCCAGAUU CAGGGUCACC
UCCUCUGGGA AGCCCACCUU GGCCUCCAGG
UUGACUCUCA CUACUCAUCA UCAGGUUCUU
CCUUCUAUUC CAGCCCUAAC CACUCAGGAU
UGGGCCGUUU GUGUCUGGGU AUGUCUCUUC
CAGCUGCCUG GGUUUCCUGG AAAGAACUCU
UAUCCCCAGG AACUAGUUUG UUGAAUAAAU
GCUGGUGAAU GAAUGAAUGA UUGAACAGAU
GAAUGAGUGA UGAGUAGAUA AAAGGAUGGA
UGGAGAGAUG GGUGAGUACA UGGAUGGAUA
GAUGGAUGAG UUGGUGGGUA GAUUCGUGGC
UAGAUGGAUG AUGGAUGGAU GGACAGAUGG
AUGGAUAUAU GAUUGAACUA UUGAAAGUAU
AGAUGUAUGG AUGGGUGAAU UUGGGGGUAA
UUGUUAGAUG AUGGAUGAGU AUAGAUGAAU
GAUGGAUGGA UAACUUGAUG AGUGGAUAGA
UAGAUUGCUG GAUAGAUGAU UGACUGGGUG
GAUAGAUGAA AUGUUGGAUG AGCAGAUUAA
GUUGUAUUGG AUGGGAUGGA UGGAAGUGUG
GUUGAGUUAU UAGAAGGAAG AUUGAGUAGA
UAGGUGAAUU UGUUGAUAGU CAGAUGGGUA
GAUAGGUAGA UGGAUGGAUG GAUGGAUGGA
UGUAUAGGCA GAUGGACAAA UGGAUGAAUG
GGUGGGUGGA UGAAUGGAAG GAUGUGUGGU
UGAACUAUUG CAAGUAUUGA UAAUUGGGUU
CAUAAUUUCU GAAUAUUUAG AUGGAUGGUU
GUGAGUGGCU GGUGGACAGA CGAAAAAUGG
AUGGUUGGAU AAAUUGAUGG GUGGAUGGAU
GGUUGGUUGU AUGAAAGAAU GAAUGAUUGG
GUAGGUGGAU UAAGUUGCGG AUCAAUGUAU
GGGAUGGAUG AAUGGAUGGA UGGAUGGAUG
UGUGGUUGAA UUACUGAAAG GUUGGAAGAG
UGGAUGGGUG AAAUUUGGGG UAGUUAGAUG
GGUGGGUGUG UGGAUGGAUA AAAGAGUAGA
UGAAUGAAUU AAUGAAUAAA CAGGCAGAUG
GAUGAUGUAA GCUGCCCCAG ACCCUGGGAC
CUCUGACCCC CGGCGACCCC UUGCACUCUC
CAUGACACUU UCUCUCCCAU GGUGGCAG

Methods of treatment may include any number of modes of administering a disclosed composition. Modes of administration may include aqueous, lipid, oily or other solutions, solutions in simulated cerebrospinal fluid, emulsions such as oil-in-water emulsions, liposomes, aqueous or oily suspensions and the like. Typically, an ASO of the disclosure will be administered directly to the CNS of the subject. Accordingly, the formulation or composition will be sterile and more preferably be suitable for injection. The following formulations and methods are merely exemplary and are in no way limiting.

Formulations suitable for parenteral administration include aqueous and non-aqueous, isotonic sterile injection solutions, which may contain anti-oxidants, buffers, bacteriostats, and solutes that render the formulation isotonic with the blood of the intended recipient, and aqueous and non-aqueous sterile suspensions that may include suspending agents, solubilizers, thickening agents, stabilizers, and preservatives. The formulations may be presented in unit-dose or multi-dose sealed containers, such as ampules and vials, and may be stored as liquids or in a freeze-dried (lyophilized) condition requiring only the addition of the sterile liquid excipient, for example, water for injections, immediately prior to use. Extemporaneous injection solutions and suspensions may be prepared from sterile powders, granules, and tablets. The formulation may be provided in a pre-filled syringe.

Additional therapeutic agent(s) may be administered simultaneously or sequentially with the disclosed one or more antisense or inhibitory nucleic acids and compositions.

Sequential administration includes administration before or after the disclosed one or more antisense or inhibitory nucleic acids or compositions. In some embodiments, the additional therapeutic agent or agents may be administered in the same composition as the disclosed one or more antisense or inhibitory nucleic acids. In other embodiments, there may be an interval of time between administration of the additional therapeutic agent and the disclosed one or more antisense or inhibitory nucleic acids. In some embodiments, administration of an additional therapeutic agent with a disclosed one or more antisense or inhibitory nucleic acids may allow lower doses of the other therapeutic agents and/or administration at less frequent intervals. When used in combination with one or more other active ingredients, the one or more antisense or inhibitory nucleic acids of the disclosure and the other active ingredients may be used in lower doses than when each is used singly. Accordingly, the pharmaceutical compositions of the disclosure include those that contain one or more other active ingredients, in addition to one or more antisense or inhibitory nucleic acids of the disclosure. The above combinations include combinations of one or more antisense or inhibitory nucleic acids of the disclosure not only with one other active compound, but also with two or more other active compounds. For example, the compound of the disclosure may be combined with a variety of drugs to treat neurological diseases. The antisense oligonucleotide may be covalently linked to another oligonucleotide, such as one with a target other than PIKFYVE. The antisense oligonucleotide may be covalently linked to an antibody.

The disclosed one or more antisense or inhibitory nucleic acids can be combined with the following, but are not limited, anticholinergic drugs, anticonvulsants, antidepressants, benzodiazepines, decongestants, muscle relaxants, pain medications, and/or stimulants. Additional types of therapy and treatment include, but are not limited to digital communication devices, feeding tubes, mechanical ventilation, nutritional support, deep brain stimulation, occupational therapy, physical therapy, and/or speech therapy.

The disclosed composition(s) may be incorporated into a pharmaceutical composition suitable for administration to a subject (such as a patient, which may be a human or non-human). The pharmaceutical compositions may comprise a carrier (e.g., a pharmaceutically acceptable carrier). Any suitable carrier can be used within the context of the disclosure, and such carriers are well known in the art. The choice of carrier will be determined, in part, by the particular use of the composition (e.g., administration to an animal) and the particular method used to administer the composition. Accordingly, there is a wide variety of suitable formulations of the composition of the present invention.

The pharmaceutical compositions may include a therapeutically effective amount or a prophylactically effective amount of the antisense oligonucleotide. A therapeutically effective amount of the composition may be determined by a person skilled in the art and may vary according to factors such as the disease state, age, sex, and weight of the individual, and the ability of the composition to elicit a desired response in the individual. A therapeutically effective amount is also one in which any toxic or detrimental effects of one or more antisense or inhibitory nucleic acids of the disclosure are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

The pharmaceutical compositions may include one or more pharmaceutically acceptable carriers. The term "pharmaceutically acceptable carrier," as used herein, means a non-toxic, inert solid, semi-solid or liquid filler, diluent, encapsulating material or formulation auxiliary of any type. Some examples of materials which can serve as pharmaceutically acceptable carriers are sugars such as, but not limited to, lactose, glucose and sucrose; starches such as, but not limited to, corn starch and potato starch; cellulose and its derivatives such as, but not limited to, sodium carboxymethyl cellulose, ethyl cellulose and cellulose acetate; powdered tragacanth; malt; gelatin; talc; excipients such as, but not limited to, cocoa butter and suppository waxes; oils such as, but not limited to, peanut oil, cottonseed oil, safflower oil, sesame oil, olive oil, corn oil and soybean oil; glycols; such as propylene glycol; esters such as, but not limited to, ethyl oleate and ethyl laurate; agar; buffering agents such as, but not limited to, magnesium hydroxide and aluminum hydroxide; alginic acid; pyrogenfree water; isotonic saline; Ringer's solution; ethyl alcohol, and phosphate buffer solutions, as well as other non-toxic compatible lubricants such as, but not limited to, sodium lauryl sulfate and magnesium stearate, as well as releasing agents, coating agents, preservatives and antioxidants may also be present in the composition, according to the judgment of the formulator.

The route by which the disclosed one or more antisense or inhibitory nucleic acids are administered, and the form of the composition will dictate the type of carrier to be used.

The pharmaceutical compositions of the disclosure can be administered in a number of ways depending upon whether local or systemic treatment is desired and upon the area to be treated. Administration can be parenteral including intravenous, intraarterial, subcutaneous, intraperitoneal or intramuscular injection or infusion; or intracranial, e.g., intrathecal, intracerebroventricular, or intraventricular, administration. In one embodiment the antisense or inhibitory nucleic acid is administered by intravenous, intraperitoneal, or as a bolus injection or administered directly into the target organ. In another embodiment, the antisense or inhibitory nucleic acid is administered intrathecally or intracerebroventricular as a bolus injection.

Carriers for systemic administration typically include at least one of solvents, diluents, lubricants, binders, disintegrants, colorants, flavors, sweeteners, antioxidants, preservatives, glidants, solvents, suspending agents, wetting agents, surfactants, combinations thereof, and others. All carriers are optional in the compositions.

Suitable diluents include sugars such as glucose, lactose, dextrose, and sucrose; diols such as propylene glycol; calcium carbonate; sodium carbonate; sugar alcohols, such as glycerin; mannitol; and sorbitol.

Suitable lubricants include silica, talc, stearic acid and its magnesium salts and calcium salts, calcium sulfate; and liquid lubricants such as polyethylene glycol and vegetable oils such as peanut oil, cottonseed oil, sesame oil, olive oil, corn oil and oil of theobroma. The amount of lubricant(s) in a systemic or topical composition is typically about 5 to about 10%.

Suitable binders include polyvinyl pyrrolidone; magnesium aluminum silicate; starches such as corn starch and potato starch; gelatin; tragacanth; and cellulose and its derivatives, such as sodium carboxymethylcellulose, ethyl cellulose, methylcellulose, microcrystalline cellulose, and sodium carboxymethylcellulose. The amount of binder(s) in a systemic composition is typically about 5 to about 50%.

Suitable disintegrants include agar, alginic acid and the sodium salt thereof, effervescent mixtures, croscarmelose, crospovidone, sodium carboxymethyl starch, sodium starch glycolate, clays, and ion exchange resins. The amount of disintegrant(s) in a systemic composition is typically about 0.1 to about 10%.

Suitable colorants include a colorant such as an FD&C dye. When used, the amount of colorant in a systemic or topical composition is typically about 0.005 to about 0.1%.

Suitable flavors include menthol, peppermint, and fruit flavors. The amount of flavor(s), when used, in a systemic or topical composition is typically about 0.1 to about 1.0%.

Suitable antioxidants include butylated hydroxyanisole ("BHA"), butylated hydroxytoluene ("BHT"), and vitamin E. The amount of antioxidant(s) in a systemic or topical composition is typically about 0.1 to about 5%.

Suitable preservatives include benzalkonium chloride, methyl paraben and sodium benzoate. The amount of preservative(s) in a systemic or topical composition is typically about 0.01 to about 5%.

Suitable glidants include silicon dioxide. The amount of glidant(s) in a systemic or topical composition is typically about 1 to about 5%.

Suitable solvents include water, isotonic saline, ethyl oleate, glycerine, hydroxylated castor oils, alcohols such as ethanol, and phosphate buffer solutions. The amount of solvent(s) in a systemic or topical composition is typically from about 0 to about 100%.

Suitable suspending agents include AVICEL RC-591 (from FMC Corporation of Philadelphia, PA) and sodium alginate. The amount of suspending agent(s) in a systemic or topical composition is typically about 1 to about 8%.

Suitable surfactants include lecithin, Polysorbate 80, and sodium lauryl sulfate, and the TWEENS from Atlas Powder Company of Wilmington, Delaware. Suitable surfactants include those disclosed in the C.T.F.A. Cosmetic Ingredient Handbook, 1992, pp.587-592; Remington's Pharmaceutical Sciences, 15th Ed. 1975, pp. 335-337; and McCutcheon's Volume 1, Emulsifiers & Detergents, 1994, North American Edition, pp. 236-239. The amount of surfactant(s) in the systemic or topical composition is typically about 0.1% to about 5%.

Compositions and formulations for parenteral, intrathecal, intra-cerebroventricular, or intraventricular administration can include sterile aqueous solutions which can also contain buffers, diluents and other suitable additives such as, but not limited to, penetration enhancers, carrier compounds and other pharmaceutically acceptable carriers or excipients. For example, an intrathecal cerebrospinal fluid (CSF) catheter can be used to deliver antisense formulations of the disclosure. The catheter can be inserted at the L3 or L4 vertebrae. The distal tip of the catheter extends within the intrathecal space to approximately the L1 vertebrae. Antisense oligonucleotides are dissolved in saline, are sterilized by filtration, and are administered at 0.33 ml/min in a 1.0 ml volume followed by a 0.5 ml sterile water flush. Total infusion time is 4.5 min.

Although the amounts of components in the systemic compositions may vary depending on the type of systemic composition prepared, in general, systemic compositions include 0.01% to 50% of active compound and 50% to 99.99% of one or more carriers. Compositions for parenteral administration typically include 0.1% to 10% of actives and 90% to 99.9% of a carrier including a diluent and a solvent.

The amount of the carrier employed in conjunction with a disclosed compound is sufficient to provide a practical quantity of composition for administration per unit dose of the medicament. Techniques and compositions for making dosage forms useful in the methods of this invention are described in the following references: Modern Pharmaceutics, Chapters 9 and 10, Banker & Rhodes, eds. (1979); Lieberman et al., Pharmaceutical Dosage Forms: Tablets (1981); and Ansel, Introduction to Pharmaceutical Dosage Forms, 2nd Ed., (1976).

In vivo testing of candidate antisense or inhibitory nucleic acids may be conducted by means known to one of ordinary skill in the art. For example, the candidate one or more antisense or inhibitory nucleic acids may be administered to a mammal, such as a mouse or a rabbit. The mammal may be administered, by any route deemed appropriate, a dose of a candidate antisense or inhibitory nucleic acids. Conventional methods and criteria can then be used to monitor animals for signs of reduction or improvement of motor neuron activity and/or expression or activity of UNC13A gene or protein, respectively. If needed, the results obtained in the presence of the candidate antisense or inhibitory nucleic acids can be compared with results in control animals that are not treated with the candidate antisense or inhibitory nucleic acids. Dosing studies may be performed in, or in conjunction with, the herein described methods for identifying one or more antisense or inhibitory nucleic acids capable of treating a neurological disease and/or any follow-on testing of candidate antisense or inhibitory nucleic acids in vivo. One of skill in the art of medicine may determine the appropriate dosage of one or more antisense or inhibitory nucleic acids. The dosage may be determined by monitoring the subject for signs of disease inhibition or amelioration. The dosage may be increased or decreased to obtain the desired frequency of treatment. The toxicity and efficacy of one or more antisense or inhibitory nucleic acids may be determined by standard pharmaceutical procedures in cell cultures or experimental animals, e.g. determining the lethal dose to 50% of the population (LD50) and the dose therapeutically effective in 50% of the population (ED50). The dose ratio of LD50/ED50 is the therapeutic index and, indicating the ratio between the toxic and therapeutic effects. A delivery system may be designed to help prevent toxic side effects, by delivering the one or more antisense or inhibitory nucleic acids to specific targets, e.g., delivered specifically to motor or central nervous system neurons. The optimal dose of the one or more antisense or inhibitory nucleic acids may be determined based on results of clinical electrophysiology or electromyography to analyze excitability in peripheral nerves, for example.

The dosage for use in humans may be determined by evaluating data obtained from animal studies and cell culture assays. The preferred dosage will have little or no toxicity and include the ED50. The dosage may vary depending on the dosage form and route of administration. For any antisense or inhibitory nucleic acid used in the methods described herein, the dosage may be estimated initially in cell culture. A dose may be formulated in animal models that includes the concentration of the test compound which achieves a half maximal inhibition of symptoms (LD50) as determined in cell culture. Such information obtained from cell cultures and animal models may be used to more accurately determine useful doses in humans.

The disclosure provides ASOs that suppress expression of a cryptic exon between canonical exons 20 and 21 of UNC13A in human cells. The accompanying data suggest that these ASOs may be capable of preventing neurodegeneration.

EXAMPLES

Example 1

Figure 3A:
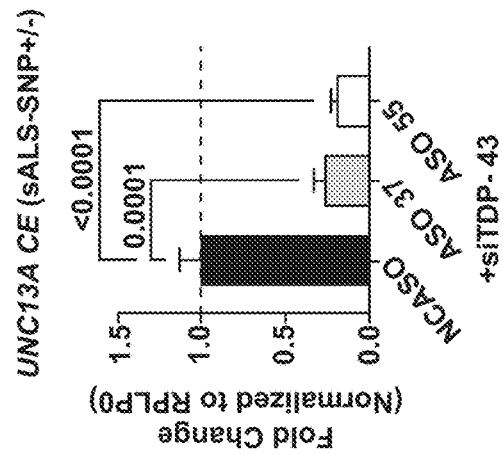
FIG. 3A is a chart showing mRNA levels of UNC13A CE after treatment with an ASO in a sporadic ALS patient line carrying the risk haplotype on one allele (annotated as +/−). qRT-PCR were performed with n=4 biological replicates. Mean +/−s.e.m. One-way ANOVA was used for statistical analysis. p-value *<0.05, <0.01, *<0.001, ****<0.0001.
Figure 3B:
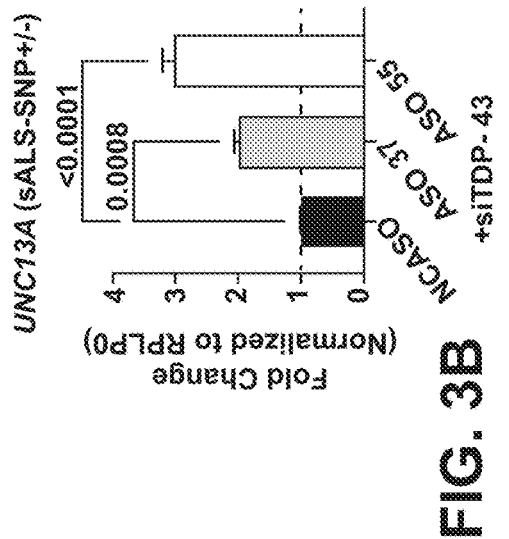
FIG. 3B is a chart showing mRNA levels of UNC13A after treatment with an ASO in a sporadic ALS patient line carrying the risk haplotype on one allele (annotated as +/−). qRT-PCR were performed with n=4 biological replicates. Mean +/−s.e.m. One-way ANOVA was used for statistical analysis. p-value *<0.05, <0.01, *<0.001, ****<0.0001.
Figure 3C:
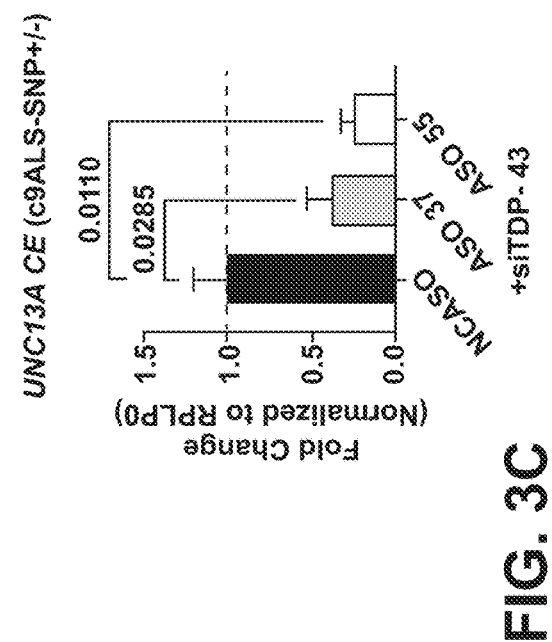
FIG. 3C is a chart showing mRNA levels of UNC13A CE after treatment with an ASO in one C9ALS patient line that does not carry the UNC13A SNPs (C9ALS-SNP-/-). qRT-PCR were performed with n=4 biological replicates. Mean +/−s.e.m. One-way ANOVA was used for statistical analysis. p-value *<0.05, <0.01, *<0.001,****<0.0001.
Figure 3D:
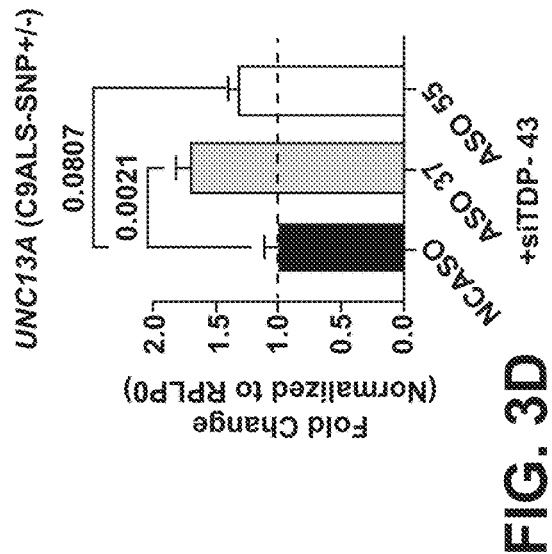
FIG. 3D is a chart showing mRNA levels of UNC13A after treatment with an ASO in one C9ALS patient line that does not carry the UNC13A SNPs (C9ALS-SNP-/-). qRT-PCR were performed with n=4 biological replicates. Mean +/−s.e.m. One-way ANOVA was used for statistical analysis. p-value *<0.05, <0.01, *<0.001,****<0.0001.
Figure 3E:
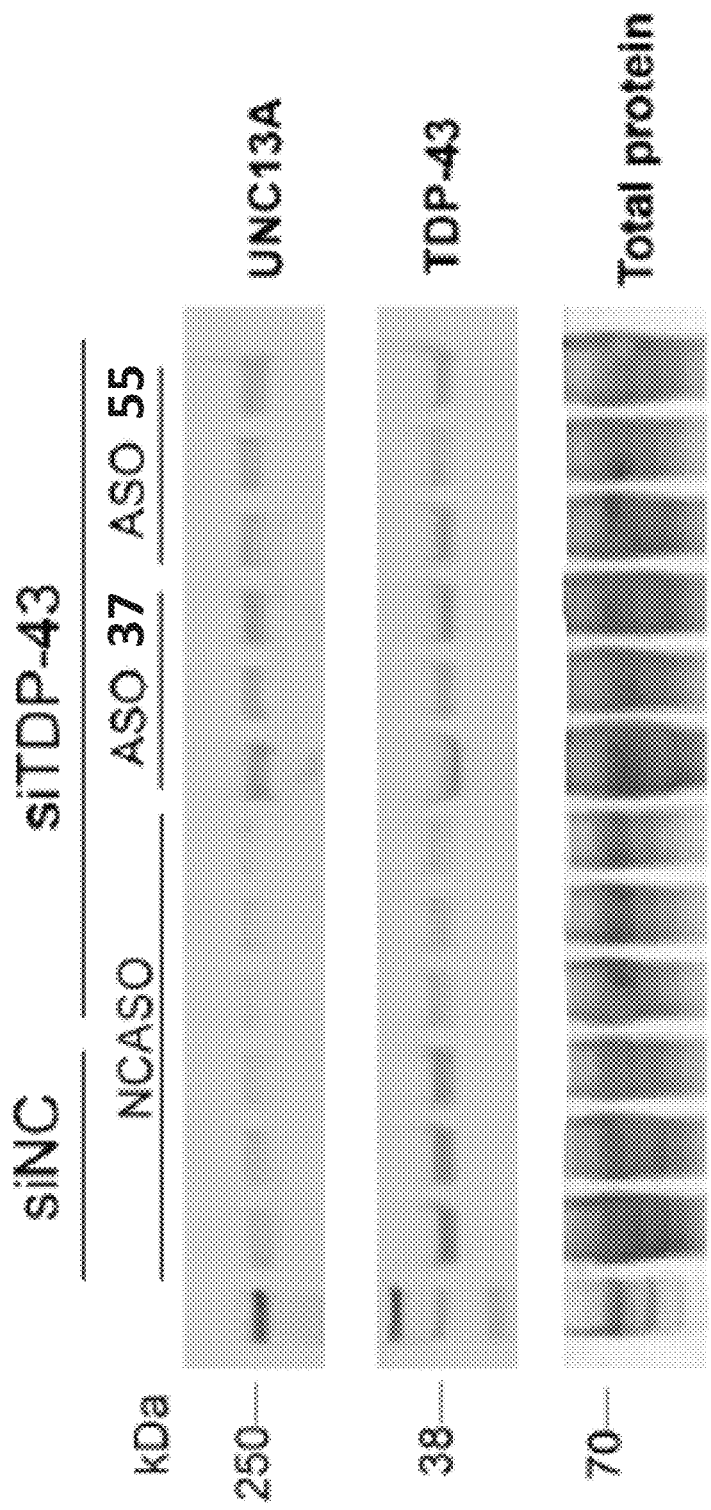
FIG. 3E is a western blot in which the protein expression of UNC13A was reduced by TDP-43 siRNA compared to negative control siRNA, where the effect can be rescued by UNC13A ASOs.
Figures 3F, 3G:
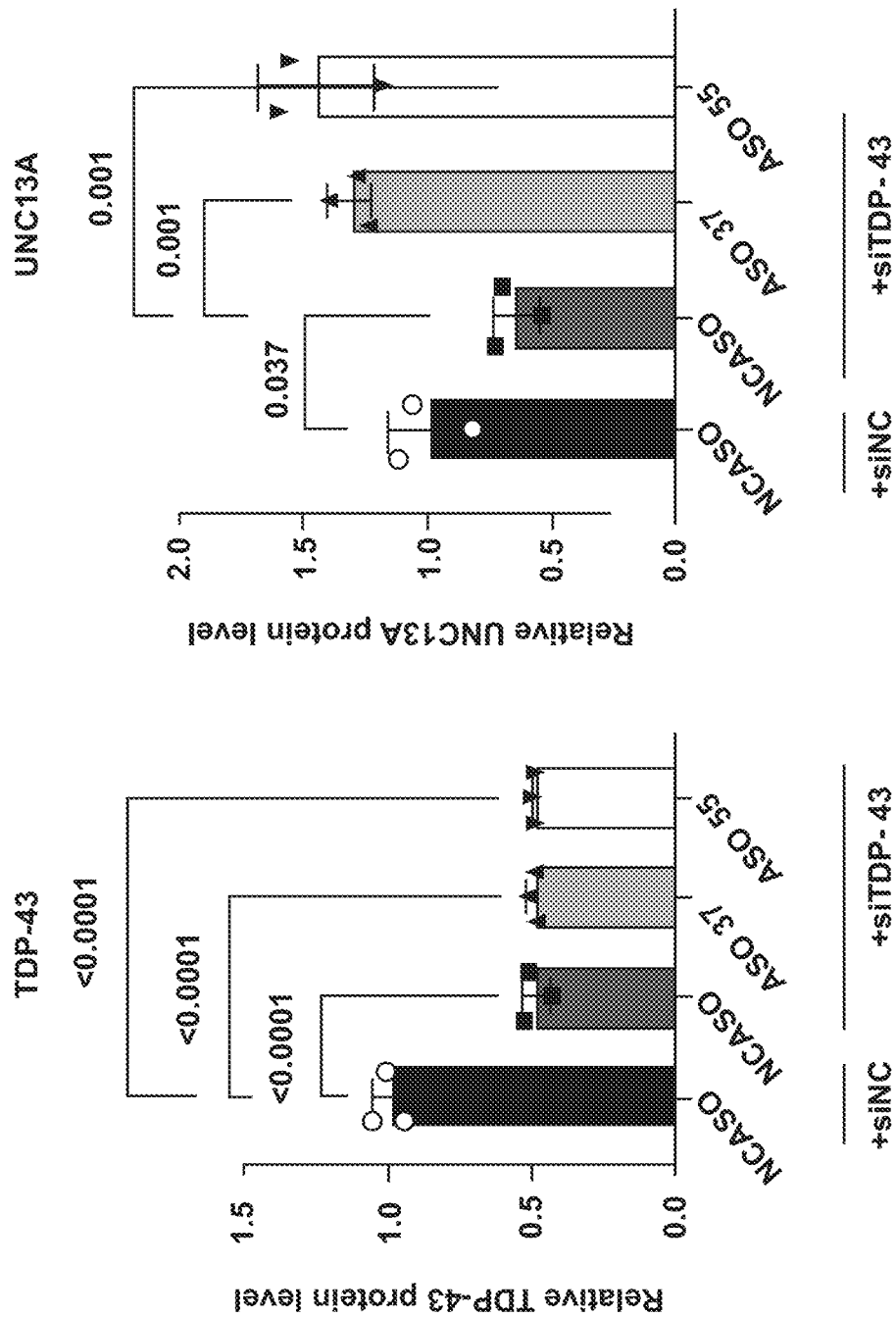
FIG. 3F is a chart showing that the level of TDP-43 protein was reduced significantly by TDP-43 siRNA (siTDP-43) compared to negative control siRNA. One-way ANOVA was performed for statistical significance.
FIG. 3G is a chart showing that the UNC13A protein level was significantly reduced by TDP-43 KD and was rescued by ASO treatment compared to negative control siRNA. One-way ANOVA was performed for statistical significance.
Figure 4A:
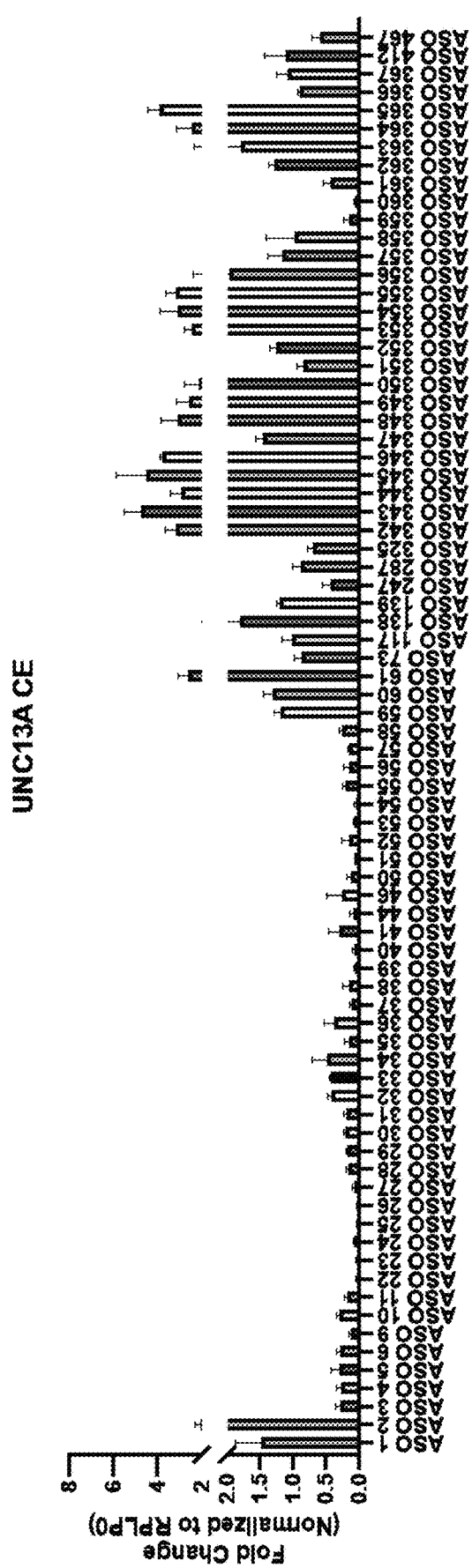
FIG. 4A is a chart showing that the efficiency in targeting the UNC13A cryptic exon is highly sequence-dependent and does not demonstrate a consistent pattern. Ngn2-induced cortical excitatory neurons were treated with 10 uM of ASOs for seven days before RNA collection. All ASOs are with 2MOE modified bases and phosphorothioate linkages. The fold change is relative to the TDP-43 siRNA+NCASO treatment group, which not shown in the chart.
Figure 4B:
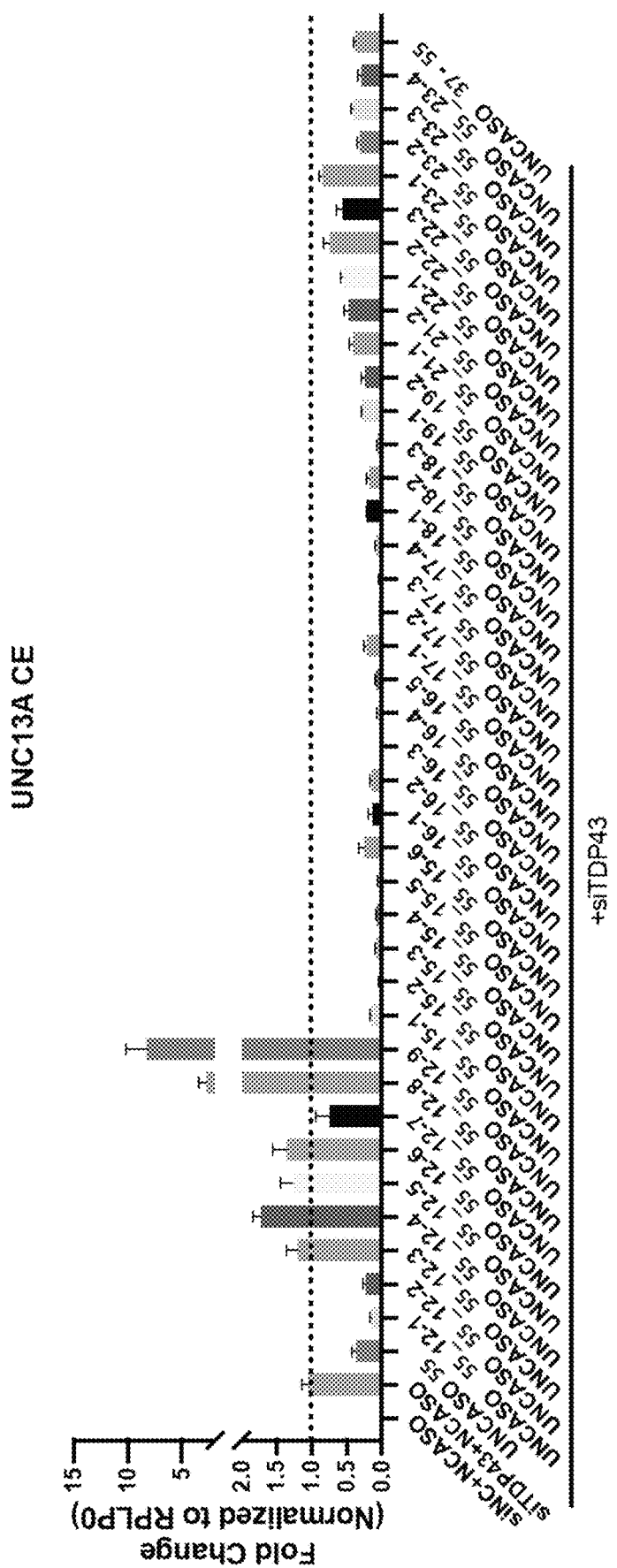
FIG. 4B is another chart showing that the efficiency in targeting the UNC13A cryptic exon is highly sequence-dependent and does not demonstrate a consistent pattern, even among variations of the same ASO (ASO 55). Ngn2-induced cortical excitatory neurons were treated with 10 uM of ASOs for seven days before RNA collection. All ASOs shown have 2MOE modified bases and phosphonothioate linkages.
Figure 4C:
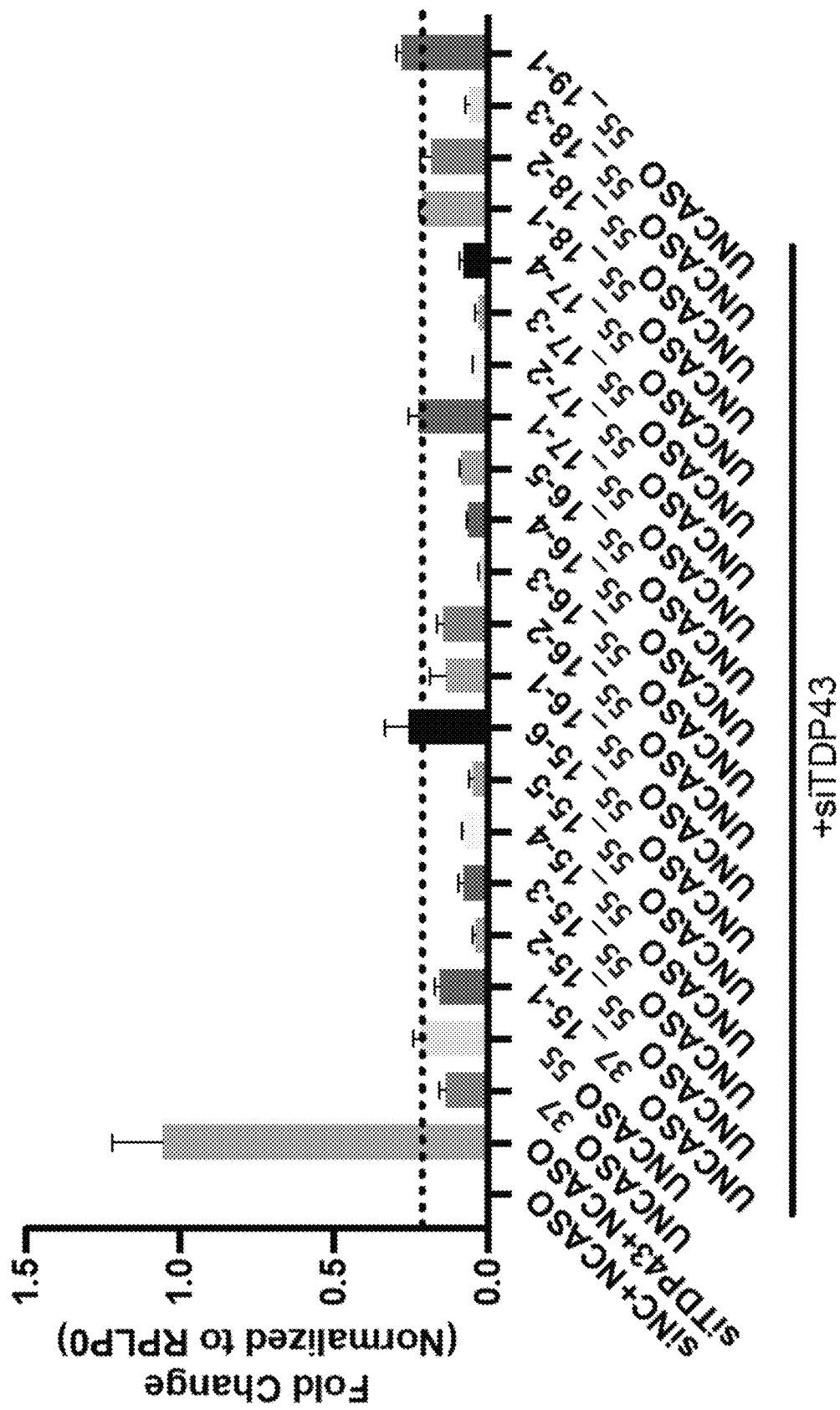
FIG. 4C is a chart showing a one-way ANOVA analysis using Dunnett's multiple comparison test to compare all test groups to the siTDP43+NCASO group. All results have p value <0.0001. The chart shows that efficiency in targeting the UNC13A cryptic exon is highly sequence-dependent and does not demonstrate a consistent pattern among ASO 55 variations.
Figure 4D:
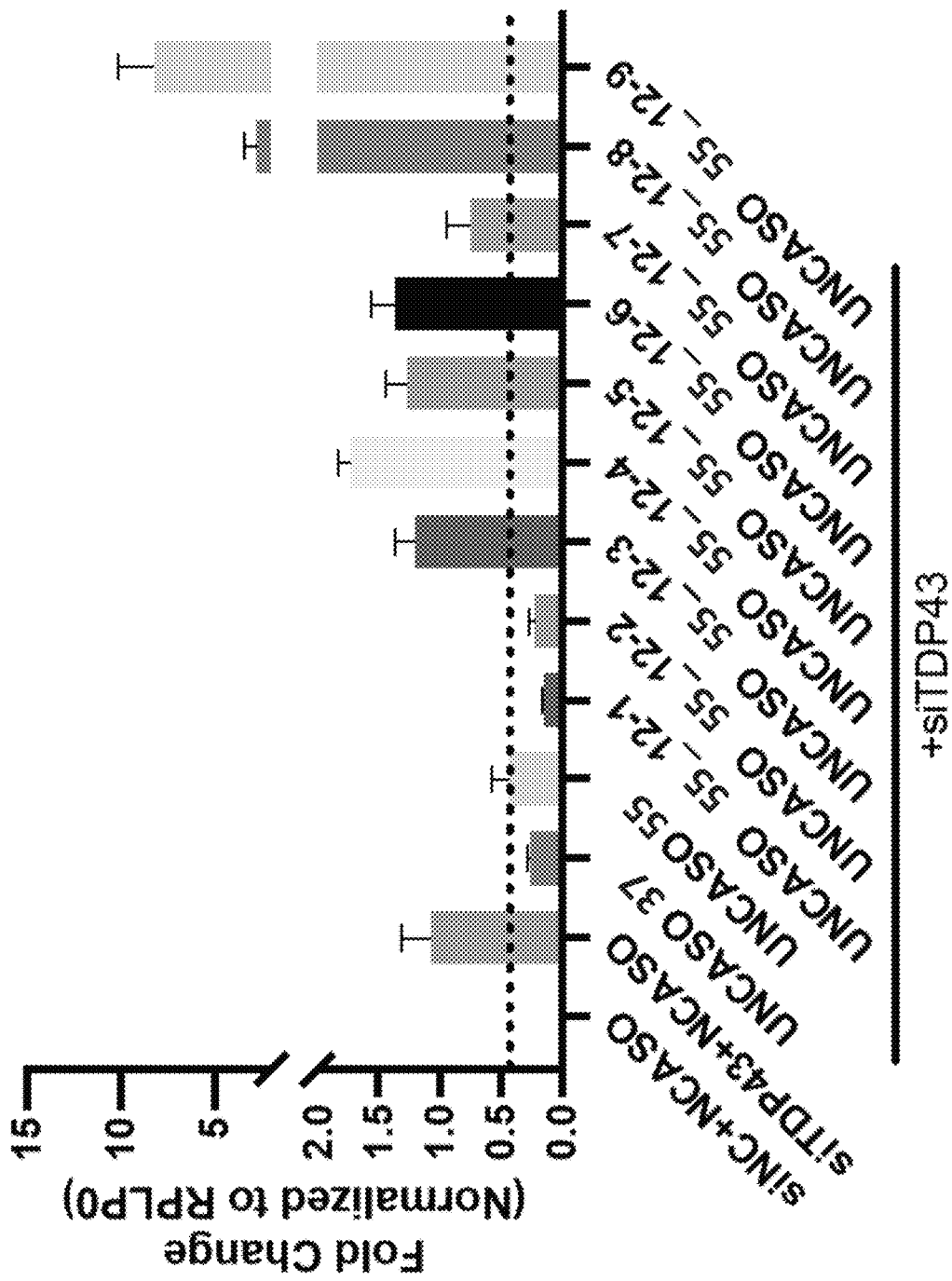
FIG. 4D is a chart showing one-way ANOVA analysis using Dunnett's multiple comparison test to compare all test groups to the siTDP43+NCASO group. Only the ASO 55_12-9 group show a significant difference (p<0.0001). However, if the ASO 55_12-9 and 55_12-8 groups are removed, ASO 37, 55, 55_12-1, 55_12-2, 55_12-4, and the siNC+NCASO showed significant differences relative to the reference group.
Figure 4E:
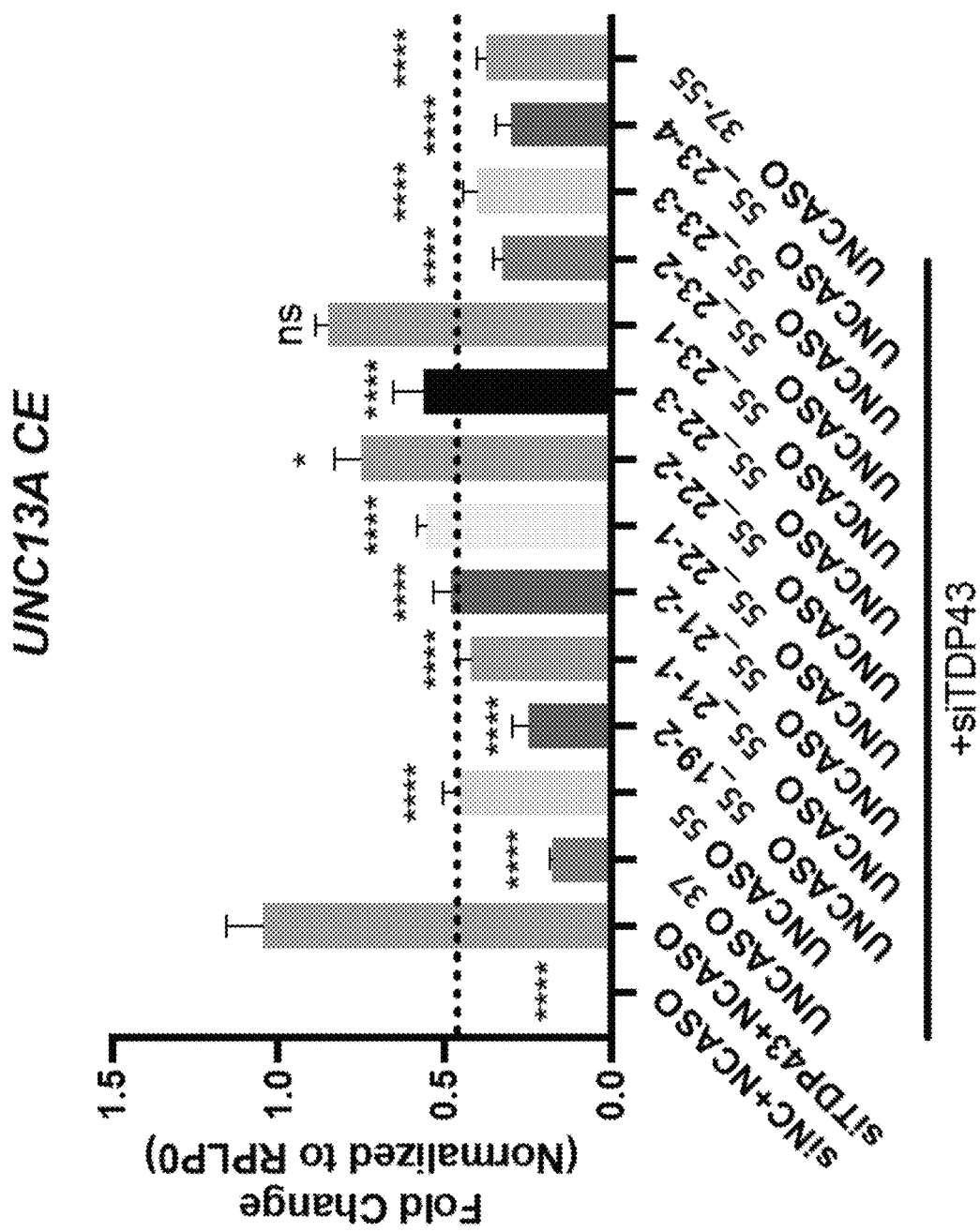
FIG. 4E is a chart showing one-way ANOVA analysis using Dunnett's multiple comparison test to compare all test groups to the siTDP43+NCASO group, demonstrating that efficiency in targeting the UNC13A cryptic exon is highly sequence-dependent and does not demonstrate a consistent pattern among ASO 55 variations.
Figure 4F:
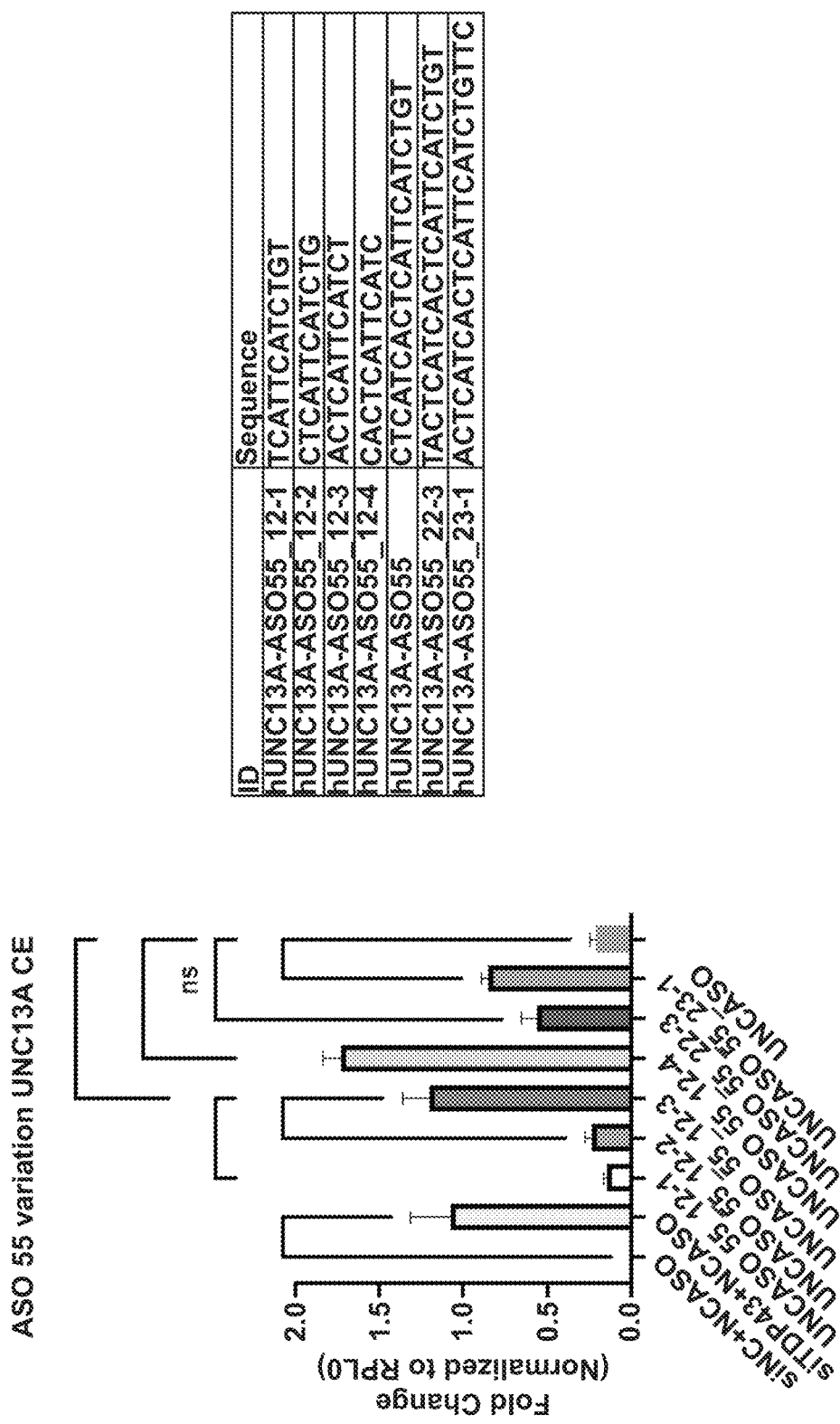
FIG. 4F is a chart showing that efficiency in targeting the UNC13A cryptic exon is highly sequence-dependent and does not demonstrate a consistent pattern among ASO 55 variations. As shown the table, the sequences in blue are identical in the 6 ASOs, and the sequences in red in the 3 ASOs were tested. For the 12mer version of ASO-55, the composition of the sequences is highly similar, but the ability to skip the UNC13A CE is largely different. Ngn2-induced cortical excitatory neurons were treated with 10 uM of ASOs for seven days before RNA collection. All ASOs are with 2MOE modified bases and phosphonothioate linkages.

To assess if patient neurons could recapitulate the cryptic exon inclusion phenotype, the genetic sequencing data of the approximately 80 ALS/FTD patient lines were reviewed, and an ALS patient heterozygous for the UNC13A risk allele was identified. Induced excitatory cortical neurons (iNs) were generated from the patient's iPSCs using the doxycycline-inducible Ngn2 method. Ngn2-iNs express at high levels the telencephalic markers Brn-2, Cux1 and FoxG1, which are characteristic of layer 2/3 excitatory cortical neurons. They form mature pre- and postsynaptic specializations and integrate into existing synaptic networks when transplanted into mouse brains. After generating iNs from this UNC13A risk SNP carrier, quantitative RT-PCR was performed and confirmed the presence of the cryptic exon cryptic exon. Since cryptic exon inclusion is known to only occur in nuclei depleted of TDP-43 postmortem, quantitative RT-PCR was performed on iNS derived from three patient lines in which TDP-43 expression was reduced using siRNA. It was found that the depletion of TDP-43 caused a >1,000 fold increase in cryptic exon levels and significantly reduced levels of the UNC13A regular transcript and protein (FIGS. 3E-3G). Thus, reduced levels of TDP-43 in the context of ALS and FTD disease cause the inclusion of a cryptic exon in UNC13A mRNA that results in lowered UNC13A protein levels.

Example 2: ASO-Mediated Suppression of Cryptic Exon Inclusion Can Rescue UNC13A Levels in Patient-Derived Neurons ASO sequences were identified based on the gene between exon 20 and 21, to tile around the cryptic exon and TDP-43 binding sites. and screened for reduction in cryptic exon inclusion and increase normal transcript expression against a control (NCASO) (data in FIG. 1). Several ASO sequences were identified that potently blocked cryptic exon inclusion (FIGS. 3A-3G), while also identifying a number of ASO sequences that did not.

FIGS. 1 and 4A-4F are charts of ASOs in UNC13A exon 20-21 to block cryptic exon expression against a control (NCASO).

The foregoing description and drawings should be considered as illustrative only of the principles of the invention. The invention is not intended to be limited by the preferred embodiment and may be implemented in a variety of ways that will be clear to one of ordinary skill in the art. Numerous applications of the invention will readily occur to those skilled in the art. Therefore, it is not desired to limit the invention to the specific examples disclosed or the exact construction and operation shown and described. Rather, all suitable modifications and equivalents may be resorted to, falling within the scope of the invention. All references cited herein are incorporated by reference.

SEQUENCE LISTING (1283 sequences)

SEQ ID NO: 1 - DNA, 20 bp, Homo sapiens
  source 1..20: mol_type = genomic DNA
gaatctacccaccaactcat

SEQ ID NO: 2 - DNA, 20 bp, Homo sapiens
  source 1..20: mol_type = genomic DNA
aatctacccaccaactcatc

SEQ ID NO: 3 - DNA, 20 bp, Homo sapiens
  source 1..20: mol_type = genomic DNA
atctacccaccaactcatcc

SEQ ID NO: 4 - DNA, 20 bp, Homo sapiens
  source 1..20: mol_type = genomic DNA
tctacccaccaactcatcca

SEQ ID NO: 5 - DNA, 20 bp, Homo sapiens
  source 1..20: mol_type = genomic DNA
ctacccaccaactcatccat

SEQ ID NO: 6 - DNA, 20 bp, Homo sapiens
  source 1..20: mol_type = genomic DNA
tacccaccaactcatccatc

SEQ ID NO: 7 - DNA, 20 bp, Homo sapiens
  source 1..20: mol_type = genomic DNA
acccaccaactcatccatct

SEQ ID NO: 8 - DNA, 20 bp, Homo sapiens
  source 1..20: mol_type = genomic DNA
cccaccaactcatccatcta

SEQ ID NO: 9 - DNA, 20 bp, Homo sapiens
  source 1..20: mol_type = genomic DNA
ccaccaactcatccatctat

SEQ ID NO: 10 - DNA, 20 bp, Homo sapiens
  source 1..20: mol_type = genomic DNA
caccaactcatccatctatc

SEQ ID NO: 11 - DNA, 20 bp, Homo sapiens
  source 1..20: mol_type = genomic DNA
accaactcatccatctatcc

SEQ ID NO: 12 - DNA, 20 bp, Homo sapiens
  source 1..20: mol_type = genomic DNA
ccaactcatccatctatcca

SEQ ID NO: 13 - DNA, 20 bp, Homo sapiens
  source 1..20: mol_type = genomic DNA
caactcatccatctatccat

SEQ ID NO: 14 - DNA, 20 bp, Homo sapiens
  source 1..20: mol_type = genomic DNA
aactcatccatctatccatc

SEQ ID NO: 15 - DNA, 20 bp, Homo sapiens
  source 1..20: mol_type = genomic DNA
actcatccatctatccatcc

SEQ ID NO: 16 - DNA, 20 bp, Homo sapiens
  source 1..20: mol_type = genomic DNA
ctcatccatctatccatcca

SEQ ID NO: 17 - DNA, 20 bp, Homo sapiens
  source 1..20: mol_type = genomic DNA
tcatccatctatccatccat

SEQ ID NO: 18 - DNA, 20 bp, Homo sapiens
  source 1..20: mol_type = genomic DNA
catccatctatccatccatg

SEQ ID NO: 19 - DNA, 20 bp, Homo sapiens
  source 1..20: mol_type = genomic DNA
atccatctatccatccatgt

SEQ ID NO: 20 - DNA, 20 bp, Homo sapiens
  source 1..20: mol_type = genomic DNA
tccatctatccatccatgta

SEQ ID NO: 21 - DNA, 20 bp, Homo sapiens
  source 1..20: mol_type = genomic DNA
ccatctatccatccatgtac

SEQ ID NO: 22 - DNA, 20 bp, Homo sapiens
  source 1..20: mol_type = genomic DNA
catctatccatccatgtact

SEQ ID NO: 23 - DNA, 20 bp, Homo sapiens
  source 1..20: mol_type = genomic DNA
atctatccatccatgtactc

SEQ ID NO: 24 - DNA, 20 bp, Homo sapiens
  source 1..20: mol_type = genomic DNA
tctatccatccatgtactca

SEQ ID NO: 25 - DNA, 20 bp, Homo sapiens
  source 1..20: mol_type = genomic DNA
ctatccatccatgtactcac

SEQ ID NO: 26 - DNA, 20 bp, Homo sapiens
  source 1..20: mol_type = genomic DNA
tatccatccatgtactcacc

SEQ ID NO: 27 - DNA, 20 bp, Homo sapiens
  source 1..20: mol_type = genomic DNA
atccatccatgtactcaccc

SEQ ID NO: 28 - DNA, 20 bp, Homo sapiens
  source 1..20: mol_type = genomic DNA
tccatccatgtactcaccca

SEQ ID NO: 29 - DNA, 20 bp, Homo sapiens
  source 1..20: mol_type = genomic DNA
ccatccatgtactcacccat

SEQ ID NO: 30 - DNA, 20 bp, Homo sapiens
  source 1..20: mol_type = genomic DNA
catccatgtactcacccatc

SEQ ID NO: 31 - DNA, 20 bp, Homo sapiens
  source 1..20: mol_type = genomic DNA
atccatgtactcacccatct

SEQ ID NO: 32 - DNA, 20 bp, Homo sapiens
  source 1..20: mol_type = genomic DNA
tccatgtactcacccatctc

SEQ ID NO: 33 - DNA, 20 bp, Homo sapiens
  source 1..20: mol_type = genomic DNA
ccatgtactcacccatctct

SEQ ID NO: 34 - DNA, 20 bp, Homo sapiens
  source 1..20: mol_type = genomic DNA
catgtactcacccatctctc

SEQ ID NO: 35 - DNA, 20 bp, Homo sapiens
  source 1..20: mol_type = genomic DNA
atgtactcacccatctctcc

SEQ ID NO: 36 - DNA, 20 bp, Homo sapiens
  source 1..20: mol_type = genomic DNA
tgtactcacccatctctcca

SEQ ID NO: 37 - DNA, 20 bp, Homo sapiens
  source 1..20: mol_type = genomic DNA
gtactcacccatctctccat

SEQ ID NO: 38 - DNA, 20 bp, Homo sapiens
  source 1..20: mol_type = genomic DNA
tactcacccatctctccatc

SEQ ID NO: 39 - DNA, 20 bp, Homo sapiens
  source 1..20: mol_type = genomic DNA
actcacccatctctccatcc

SEQ ID NO: 40 - DNA, 20 bp, Homo sapiens
  source 1..20: mol_type = genomic DNA
ctcacccatctctccatcca

SEQ ID NO: 41 - DNA, 20 bp, Homo sapiens
  source 1..20: mol_type = genomic DNA
tcacccatctctccatccat

SEQ ID NO: 42 - DNA, 20 bp, Homo sapiens
  source 1..20: mol_type = genomic DNA
cacccatctctccatccatc

SEQ ID NO: 43 - DNA, 20 bp, Homo sapiens
  source 1..20: mol_type = genomic DNA
acccatctctccatccatcc

SEQ ID NO: 44 - DNA, 20 bp, Homo sapiens
  source 1..20: mol_type = genomic DNA
cccatctctccatccatcct

SEQ ID NO: 45 - DNA, 20 bp, Homo sapiens
  source 1..20: mol_type = genomic DNA
ccatctctccatccatcctt

SEQ ID NO: 46 - DNA, 20 bp, Homo sapiens
  source 1..20: mol_type = genomic DNA
catctctccatccatccttt

SEQ ID NO: 47 - DNA, 20 bp, Homo sapiens
  source 1..20: mol_type = genomic DNA
atctctccatccatcctttt

SEQ ID NO: 48 - DNA, 20 bp, Homo sapiens
  source 1..20: mol_type = genomic DNA
tctctccatccatcctttta

SEQ ID NO: 49 - DNA, 20 bp, Homo sapiens
  source 1..20: mol_type = genomic DNA
ctctccatccatccttttat

SEQ ID NO: 50 - DNA, 20 bp, Homo sapiens
  source 1..20: mol_type = genomic DNA
tctccatccatccttttatc

SEQ ID NO: 51 - DNA, 20 bp, Homo sapiens
  source 1..20: mol_type = genomic DNA
ctccatccatccttttatct

SEQ ID NO: 52 - DNA, 20 bp, Homo sapiens
  source 1..20: mol_type = genomic DNA
ccatccatccttttatctac

SEQ ID NO: 53 - DNA, 20 bp, Homo sapiens
  source 1..20: mol_type = genomic DNA
ctactcatcactcattcatc

SEQ ID NO: 54 - DNA, 20 bp, Homo sapiens
  source 1..20: mol_type = genomic DNA
actcatcactcattcatctg

SEQ ID NO: 55 - DNA, 20 bp, Homo sapiens
  source 1..20: mol_type = genomic DNA
ctcatcactcattcatctgt

SEQ ID NO: 56 - DNA, 20 bp, Homo sapiens
  source 1..20: mol_type = genomic DNA
catcactcattcatctgttc

SEQ ID NO: 57 - DNA, 20 bp, Homo sapiens
  source 1..20: mol_type = genomic DNA
tcattcattcattcaccagc

SEQ ID NO: 58 - DNA, 20 bp, Homo sapiens
  source 1..20: mol_type = genomic DNA
cattcattcattcaccagca

SEQ ID NO: 59 - DNA, 20 bp, Homo sapiens
  source 1..20: mol_type = genomic DNA
ggataagagttctttccagg

SEQ ID NO: 60 - DNA, 20 bp, Homo sapiens
  source 1..20: mol_type = genomic DNA
gataagagttctttccagga

SEQ ID NO: 61 - DNA, 20 bp, Homo sapiens
  source 1..20: mol_type = genomic DNA
ttccaggaaacccaggcagc

SEQ ID NO: 62 - DNA, 20 bp, Homo sapiens
  source 1..20: mol_type = genomic DNA
tccaggaaacccaggcagct

SEQ ID NO: 63 - DNA, 20 bp, Homo sapiens
  source 1..20: mol_type = genomic DNA
agctggaagagacataccca

SEQ ID NO: 64 - DNA, 20 bp, Homo sapiens
  source 1..20: mol_type = genomic DNA
gctggaagagacatacccag

SEQ ID NO: 65 - DNA, 20 bp, Homo sapiens
  source 1..20: mol_type = genomic DNA
ctggaagagacatacccaga

SEQ ID NO: 66 - DNA, 20 bp, Homo sapiens
  source 1..20: mol_type = genomic DNA
tggaagagacatacccagac

SEQ ID NO: 67 - DNA, 20 bp, Homo sapiens
  source 1..20: mol_type = genomic DNA
ggaagagacatacccagaca

SEQ ID NO: 68 - DNA, 20 bp, Homo sapiens
  source 1..20: mol_type = genomic DNA
gaagagacatacccagacac

SEQ ID NO: 69 - DNA, 20 bp, Homo sapiens
  source 1..20: mol_type = genomic DNA
aagagacatacccagacaca

SEQ ID NO: 70 - DNA, 20 bp, Homo sapiens
  source 1..20: mol_type = genomic DNA
agagacatacccagacacaa

SEQ ID NO: 71 - DNA, 20 bp, Homo sapiens
  source 1..20: mol_type = genomic DNA
gagacatacccagacacaaa

SEQ ID NO: 72 - DNA, 20 bp, Homo sapiens
  source 1..20: mol_type = genomic DNA
agacatacccagacacaaac

SEQ ID NO: 73 - DNA, 20 bp, Homo sapiens
  source 1..20: mol_type = genomic DNA
gcccaatcctgagtggttag

SEQ ID NO: 74 - DNA, 20 bp, Homo sapiens
  source 1..20: mol_type = genomic DNA
cccaatcctgagtggttagg

SEQ ID NO: 75 - DNA, 20 bp, Homo sapiens
  source 1..20: mol_type = genomic DNA
ggctggaatagaaggaagaa

SEQ ID NO: 76 - DNA, 20 bp, Homo sapiens
  source 1..20: mol_type = genomic DNA
gctggaatagaaggaagaac

SEQ ID NO: 77 - DNA, 20 bp, Homo sapiens
  source 1..20: mol_type = genomic DNA
ctggaatagaaggaagaacc

SEQ ID NO: 78 - DNA, 20 bp, Homo sapiens
  source 1..20: mol_type = genomic DNA
tggaatagaaggaagaacct

SEQ ID NO: 79 - DNA, 20 bp, Homo sapiens
  source 1..20: mol_type = genomic DNA
ggaatagaaggaagaacctg

SEQ ID NO: 80 - DNA, 20 bp, Homo sapiens
  source 1..20: mol_type = genomic DNA
gaatagaaggaagaacctga

SEQ ID NO: 81 - DNA, 20 bp, Homo sapiens
  source 1..20: mol_type = genomic DNA
atagaaggaagaacctgatg

SEQ ID NO: 82 - DNA, 20 bp, Homo sapiens
  source 1..20: mol_type = genomic DNA
tagaaggaagaacctgatga

SEQ ID NO: 83 - DNA, 20 bp, Homo sapiens
  source 1..20: mol_type = genomic DNA
agaaggaagaacctgatgat

SEQ ID NO: 84 - DNA, 20 bp, Homo sapiens
  source 1..20: mol_type = genomic DNA
gaaggaagaacctgatgatg

SEQ ID NO: 85 - DNA, 20 bp, Homo sapiens
  source 1..20: mol_type = genomic DNA
aaggaagaacctgatgatga

SEQ ID NO: 86 - DNA, 20 bp, Homo sapiens
  source 1..20: mol_type = genomic DNA
aggaagaacctgatgatgag

SEQ ID NO: 87 - DNA, 20 bp, Homo sapiens
  source 1..20: mol_type = genomic DNA
ggaagaacctgatgatgagt

SEQ ID NO: 88 - DNA, 20 bp, Homo sapiens
  source 1..20: mol_type = genomic DNA
gaagaacctgatgatgagta

SEQ ID NO: 89 - DNA, 20 bp, Homo sapiens
  source 1..20: mol_type = genomic DNA
aagaacctgatgatgagtag

SEQ ID NO: 90 - DNA, 20 bp, Homo sapiens
  source 1..20: mol_type = genomic DNA
agaacctgatgatgagtagt

SEQ ID NO: 91 - DNA, 20 bp, Homo sapiens
  source 1..20: mol_type = genomic DNA
gaacctgatgatgagtagtg

SEQ ID NO: 92 - DNA, 20 bp, Homo sapiens
  source 1..20: mol_type = genomic DNA
aacctgatgatgagtagtga

SEQ ID NO: 93 - DNA, 20 bp, Homo sapiens
  source 1..20: mol_type = genomic DNA
acctgatgatgagtagtgag

SEQ ID NO: 94 - DNA, 20 bp, Homo sapiens
  source 1..20: mol_type = genomic DNA
cctgatgatgagtagtgaga

SEQ ID NO: 95 - DNA, 20 bp, Homo sapiens
  source 1..20: mol_type = genomic DNA
ctgatgatgagtagtgagag

SEQ ID NO: 96 - DNA, 20 bp, Homo sapiens
  source 1..20: mol_type = genomic DNA
tgatgatgagtagtgagagt

SEQ ID NO: 97 - DNA, 20 bp, Homo sapiens
  source 1..20: mol_type = genomic DNA
gatgatgagtagtgagagtc

SEQ ID NO: 98 - DNA, 20 bp, Homo sapiens
  source 1..20: mol_type = genomic DNA
atgatgagtagtgagagtca

SEQ ID NO: 99 - DNA, 20 bp, Homo sapiens
  source 1..20: mol_type = genomic DNA
tgatgagtagtgagagtcaa

SEQ ID NO: 100 - DNA, 20 bp, Homo sapiens
  source 1..20: mol_type = genomic DNA
gatgagtagtgagagtcaac

SEQ ID NO: 101 - DNA, 20 bp, Homo sapiens
  source 1..20: mol_type = genomic DNA
atgagtagtgagagtcaacc

SEQ ID NO: 102 - DNA, 20 bp, Homo sapiens
  source 1..20: mol_type = genomic DNA
tgagtagtgagagtcaacct

SEQ ID NO: 103 - DNA, 20 bp, Homo sapiens
  source 1..20: mol_type = genomic DNA
gagtagtgagagtcaacctg

SEQ ID NO: 104 - DNA, 20 bp, Homo sapiens
  source 1..20: mol_type = genomic DNA
agtagtgagagtcaacctgg

SEQ ID NO: 105 - DNA, 20 bp, Homo sapiens
  source 1..20: mol_type = genomic DNA
gtagtgagagtcaacctgga

SEQ ID NO: 106 - DNA, 20 bp, Homo sapiens
  source 1..20: mol_type = genomic DNA
tagtgagagtcaacctggag

SEQ ID NO: 107 - DNA, 20 bp, Homo sapiens
  source 1..20: mol_type = genomic DNA
agtgagagtcaacctggagg

SEQ ID NO: 108 - DNA, 20 bp, Homo sapiens
  source 1..20: mol_type = genomic DNA
gtgagagtcaacctggaggc

SEQ ID NO: 109 - DNA, 20 bp, Homo sapiens
  source 1..20: mol_type = genomic DNA
ttcccagaggaggtgaccct

SEQ ID NO: 110 - DNA, 20 bp, Homo sapiens
  source 1..20: mol_type = genomic DNA
ccagaggaggtgaccctgaa

SEQ ID NO: 111 - DNA, 20 bp, Homo sapiens
  source 1..20: mol_type = genomic DNA
cagaggaggtgaccctgaat

SEQ ID NO: 112 - DNA, 20 bp, Homo sapiens
  source 1..20: mol_type = genomic DNA
agaggaggtgaccctgaatc

SEQ ID NO: 113 - DNA, 20 bp, Homo sapiens
  source 1..20: mol_type = genomic DNA
gaggaggtgaccctgaatct

SEQ ID NO: 114 - DNA, 20 bp, Homo sapiens
  source 1..20: mol_type = genomic DNA
aggaggtgaccctgaatctg

SEQ ID NO: 115 - DNA, 20 bp, Homo sapiens
  source 1..20: mol_type = genomic DNA
ggaggtgaccctgaatctgg

SEQ ID NO: 116 - DNA, 20 bp, Homo sapiens
  source 1..20: mol_type = genomic DNA
gaggtgaccctgaatctgga

SEQ ID NO: 117 - DNA, 20 bp, Homo sapiens
  source 1..20: mol_type = genomic DNA
aggtgaccctgaatctggac

SEQ ID NO: 118 - DNA, 20 bp, Homo sapiens
  source 1..20: mol_type = genomic DNA
ggtgaccctgaatctggact

SEQ ID NO: 119 - DNA, 20 bp, Homo sapiens
  source 1..20: mol_type = genomic DNA
gtgaccctgaatctggactt

SEQ ID NO: 120 - DNA, 20 bp, Homo sapiens
  source 1..20: mol_type = genomic DNA
tgaccctgaatctggacttt

SEQ ID NO: 121 - DNA, 20 bp, Homo sapiens
  source 1..20: mol_type = genomic DNA
gaccctgaatctggactttg

SEQ ID NO: 122 - DNA, 20 bp, Homo sapiens
  source 1..20: mol_type = genomic DNA
accctgaatctggactttga

SEQ ID NO: 123 - DNA, 20 bp, Homo sapiens
  source 1..20: mol_type = genomic DNA
ccctgaatctggactttgat

SEQ ID NO: 124 - DNA, 20 bp, Homo sapiens
  source 1..20: mol_type = genomic DNA
cctgaatctggactttgatg

SEQ ID NO: 125 - DNA, 20 bp, Homo sapiens
  source 1..20: mol_type = genomic DNA
ctgaatctggactttgatgg

SEQ ID NO: 126 - DNA, 20 bp, Homo sapiens
  source 1..20: mol_type = genomic DNA
tgaatctggactttgatgga

SEQ ID NO: 127 - DNA, 20 bp, Homo sapiens
  source 1..20: mol_type = genomic DNA
gaatctggactttgatggat

SEQ ID NO: 128 - DNA, 20 bp, Homo sapiens
  source 1..20: mol_type = genomic DNA
atctggactttgatggatag

SEQ ID NO: 129 - DNA, 20 bp, Homo sapiens
  source 1..20: mol_type = genomic DNA
tctggactttgatggatagg

SEQ ID NO: 130 - DNA, 20 bp, Homo sapiens
  source 1..20: mol_type = genomic DNA
ggaggagttttccaggtaaa

SEQ ID NO: 131 - DNA, 20 bp, Homo sapiens
  source 1..20: mol_type = genomic DNA
gaggagttttccaggtaaag

SEQ ID NO: 132 - DNA, 20 bp, Homo sapiens
  source 1..20: mol_type = genomic DNA
aggagttttccaggtaaagg

SEQ ID NO: 133 - DNA, 20 bp, Homo sapiens
  source 1..20: mol_type = genomic DNA
gccaggagagtgtggatggt

SEQ ID NO: 134 - DNA, 20 bp, Homo sapiens
  source 1..20: mol_type = genomic DNA
ccaggagagtgtggatggtg

SEQ ID NO: 135 - DNA, 20 bp, Homo sapiens
  source 1..20: mol_type = genomic DNA
caggagagtgtggatggtgt

SEQ ID NO: 136 - DNA, 20 bp, Homo sapiens
  source 1..20: mol_type = genomic DNA
aggagagtgtggatggtgtg

SEQ ID NO: 137 - DNA, 20 bp, Homo sapiens
  source 1..20: mol_type = genomic DNA
ggagagtgtggatggtgtgg

SEQ ID NO: 138 - DNA, 20 bp, Homo sapiens
  source 1..20: mol_type = genomic DNA
gagagtgtggatggtgtggc

SEQ ID NO: 139 - DNA, 20 bp, Homo sapiens
  source 1..20: mol_type = genomic DNA
aattacccccaaattcaccc

SEQ ID NO: 140 - DNA, 20 bp, Homo sapiens
  source 1..20: mol_type = genomic DNA
attacccccaaattcaccca

SEQ ID NO: 141 - DNA, 20 bp, Homo sapiens
  source 1..20: mol_type = genomic DNA
ttacccccaaattcacccat

SEQ ID NO: 142 - DNA, 20 bp, Homo sapiens
  source 1..20: mol_type = genomic DNA
tacccccaaattcacccatc

SEQ ID NO: 143 - DNA, 20 bp, Homo sapiens
  source 1..20: mol_type = genomic DNA
acccccaaattcacccatcc

SEQ ID NO: 144 - DNA, 20 bp, Homo sapiens
  source 1..20: mol_type = genomic DNA
cccccaaattcacccatcca

SEQ ID NO: 145 - DNA, 20 bp, Homo sapiens
  source 1..20: mol_type = genomic DNA
ccccaaattcacccatccat

SEQ ID NO: 146 - DNA, 20 bp, Homo sapiens
  source 1..20: mol_type = genomic DNA
cccaaattcacccatccata

SEQ ID NO: 147 - DNA, 20 bp, Homo sapiens
  source 1..20: mol_type = genomic DNA
ccaaattcacccatccatac

SEQ ID NO: 148 - DNA, 20 bp, Homo sapiens
  source 1..20: mol_type = genomic DNA
caaattcacccatccataca

SEQ ID NO: 149 - DNA, 20 bp, Homo sapiens
  source 1..20: mol_type = genomic DNA
aattcacccatccatacatc

SEQ ID NO: 150 - DNA, 20 bp, Homo sapiens
  source 1..20: mol_type = genomic DNA
attcacccatccatacatct

SEQ ID NO: 151 - DNA, 20 bp, Homo sapiens
  source 1..20: mol_type = genomic DNA
ttcacccatccatacatcta

SEQ ID NO: 152 - DNA, 20 bp, Homo sapiens
  source 1..20: mol_type = genomic DNA
tcacccatccatacatctat

SEQ ID NO: 153 - DNA, 20 bp, Homo sapiens
  source 1..20: mol_type = genomic DNA
cacccatccatacatctata

SEQ ID NO: 154 - DNA, 20 bp, Homo sapiens
  source 1..20: mol_type = genomic DNA
acccatccatacatctatac

SEQ ID NO: 155 - DNA, 20 bp, Homo sapiens
  source 1..20: mol_type = genomic DNA
cccatccatacatctatact

SEQ ID NO: 156 - DNA, 20 bp, Homo sapiens
  source 1..20: mol_type = genomic DNA
catatatccatccatctgtc

SEQ ID NO: 157 - DNA, 20 bp, Homo sapiens
  source 1..20: mol_type = genomic DNA
atatatccatccatctgtcc

SEQ ID NO: 158 - DNA, 20 bp, Homo sapiens
  source 1..20: mol_type = genomic DNA
tatatccatccatctgtcca

SEQ ID NO: 159 - DNA, 20 bp, Homo sapiens
  source 1..20: mol_type = genomic DNA
atatccatccatctgtccat

SEQ ID NO: 160 - DNA, 20 bp, Homo sapiens
  source 1..20: mol_type = genomic DNA
tatccatccatctgtccatc

SEQ ID NO: 161 - DNA, 20 bp, Homo sapiens
  source 1..20: mol_type = genomic DNA
atccatccatctgtccatcc

SEQ ID NO: 162 - DNA, 20 bp, Homo sapiens
  source 1..20: mol_type = genomic DNA
tccatccatctgtccatcca

SEQ ID NO: 163 - DNA, 20 bp, Homo sapiens
  source 1..20: mol_type = genomic DNA
ccatccatctgtccatccat

SEQ ID NO: 164 - DNA, 20 bp, Homo sapiens
  source 1..20: mol_type = genomic DNA
catccatctgtccatccatc

SEQ ID NO: 165 - DNA, 20 bp, Homo sapiens
  source 1..20: mol_type = genomic DNA
atccatctgtccatccatcc

SEQ ID NO: 166 - DNA, 20 bp, Homo sapiens
  source 1..20: mol_type = genomic DNA
tccatctgtccatccatcca

SEQ ID NO: 167 - DNA, 20 bp, Homo sapiens
  source 1..20: mol_type = genomic DNA
ccatctgtccatccatccat

SEQ ID NO: 168 - DNA, 20 bp, Homo sapiens
  source 1..20: mol_type = genomic DNA
catctgtccatccatccatc

SEQ ID NO: 169 - DNA, 20 bp, Homo sapiens
  source 1..20: mol_type = genomic DNA
atctgtccatccatccatca

SEQ ID NO: 170 - DNA, 20 bp, Homo sapiens
  source 1..20: mol_type = genomic DNA
tctgtccatccatccatcat

SEQ ID NO: 171 - DNA, 20 bp, Homo sapiens
  source 1..20: mol_type = genomic DNA
ctgtccatccatccatcatc

SEQ ID NO: 172 - DNA, 20 bp, Homo sapiens
  source 1..20: mol_type = genomic DNA
tgtccatccatccatcatcc

SEQ ID NO: 173 - DNA, 20 bp, Homo sapiens
  source 1..20: mol_type = genomic DNA
gtccatccatccatcatcca

SEQ ID NO: 174 - DNA, 20 bp, Homo sapiens
  source 1..20: mol_type = genomic DNA
tccatccatccatcatccat

SEQ ID NO: 175 - DNA, 20 bp, Homo sapiens
  source 1..20: mol_type = genomic DNA
ccatccatccatcatccatc

SEQ ID NO: 176 - DNA, 20 bp, Homo sapiens
  source 1..20: mol_type = genomic DNA
catccatccatcatccatct

SEQ ID NO: 177 - DNA, 20 bp, Homo sapiens
  source 1..20: mol_type = genomic DNA
atccatccatcatccatcta

SEQ ID NO: 178 - DNA, 20 bp, Homo sapiens
  source 1..20: mol_type = genomic DNA
tccatccatcatccatctag

SEQ ID NO: 179 - DNA, 20 bp, Homo sapiens
  source 1..20: mol_type = genomic DNA
ccatccatcatccatctagc

SEQ ID NO: 180 - DNA, 20 bp, Homo sapiens
  source 1..20: mol_type = genomic DNA
catccatcatccatctagcc

SEQ ID NO: 181 - DNA, 20 bp, Homo sapiens
  source 1..20: mol_type = genomic DNA
atccatcatccatctagcca

SEQ ID NO: 182 - DNA, 20 bp, Homo sapiens
  source 1..20: mol_type = genomic DNA
tccatcatccatctagccac

SEQ ID NO: 183 - DNA, 20 bp, Homo sapiens
  source 1..20: mol_type = genomic DNA
ggagagaaagtgtcatggag

SEQ ID NO: 184 - DNA, 20 bp, Homo sapiens
  source 1..20: mol_type = genomic DNA
gagagaaagtgtcatggaga

SEQ ID NO: 185 - DNA, 20 bp, Homo sapiens
  source 1..20: mol_type = genomic DNA
agagaaagtgtcatggagag

SEQ ID NO: 186 - DNA, 20 bp, Homo sapiens
  source 1..20: mol_type = genomic DNA
gagaaagtgtcatggagagt

SEQ ID NO: 187 - DNA, 20 bp, Homo sapiens
  source 1..20: mol_type = genomic DNA
agaaagtgtcatggagagtg

SEQ ID NO: 188 - DNA, 20 bp, Homo sapiens
  source 1..20: mol_type = genomic DNA
gaaagtgtcatggagagtgc

SEQ ID NO: 189 - DNA, 20 bp, Homo sapiens
  source 1..20: mol_type = genomic DNA
ggcagcttacatcatccatc

SEQ ID NO: 190 - DNA, 20 bp, Homo sapiens
  source 1..20: mol_type = genomic DNA
gcagcttacatcatccatct

SEQ ID NO: 191 - DNA, 20 bp, Homo sapiens
  source 1..20: mol_type = genomic DNA
cagcttacatcatccatctg

SEQ ID NO: 192 - DNA, 20 bp, Homo sapiens
  source 1..20: mol_type = genomic DNA
agcttacatcatccatctgc

SEQ ID NO: 193 - DNA, 20 bp, Homo sapiens
  source 1..20: mol_type = genomic DNA
gcttacatcatccatctgcc

SEQ ID NO: 194 - DNA, 20 bp, Homo sapiens
  source 1..20: mol_type = genomic DNA
cttacatcatccatctgcct

SEQ ID NO: 195 - DNA, 20 bp, Homo sapiens
  source 1..20: mol_type = genomic DNA
ttacatcatccatctgcctg

SEQ ID NO: 196 - DNA, 20 bp, Homo sapiens
  source 1..20: mol_type = genomic DNA
tacatcatccatctgcctgt

SEQ ID NO: 197 - DNA, 20 bp, Homo sapiens
  source 1..20: mol_type = genomic DNA
acatcatccatctgcctgtt

SEQ ID NO: 198 - DNA, 20 bp, Homo sapiens
  source 1..20: mol_type = genomic DNA
catcatccatctgcctgttt

SEQ ID NO: 199 - DNA, 20 bp, Homo sapiens
  source 1..20: mol_type = genomic DNA
atcatccatctgcctgttta

SEQ ID NO: 200 - DNA, 20 bp, Homo sapiens
  source 1..20: mol_type = genomic DNA
tcatccatctgcctgtttat

SEQ ID NO: 201 - DNA, 20 bp, Homo sapiens
  source 1..20: mol_type = genomic DNA
catccatctgcctgtttatt

SEQ ID NO: 202 - DNA, 20 bp, Homo sapiens
  source 1..20: mol_type = genomic DNA
atccatctgcctgtttattc

SEQ ID NO: 203 - DNA, 20 bp, Homo sapiens
  source 1..20: mol_type = genomic DNA
tccatctgcctgtttattca

SEQ ID NO: 204 - DNA, 20 bp, Homo sapiens
  source 1..20: mol_type = genomic DNA
ccatctgcctgtttattcat

SEQ ID NO: 205 - DNA, 20 bp, Homo sapiens
  source 1..20: mol_type = genomic DNA
ctactcttttatccatccac

SEQ ID NO: 206 - DNA, 20 bp, Homo sapiens
  source 1..20: mol_type = genomic DNA
actcttttatccatccacac

SEQ ID NO: 207 - DNA, 20 bp, Homo sapiens
  source 1..20: mol_type = genomic DNA
ctcttttatccatccacaca

SEQ ID NO: 208 - DNA, 20 bp, Homo sapiens
  source 1..20: mol_type = genomic DNA
tcttttatccatccacacac

SEQ ID NO: 209 - DNA, 20 bp, Homo sapiens
  source 1..20: mol_type = genomic DNA
cttttatccatccacacacc

SEQ ID NO: 210 - DNA, 20 bp, Homo sapiens
  source 1..20: mol_type = genomic DNA
ttttatccatccacacaccc

SEQ ID NO: 211 - DNA, 20 bp, Homo sapiens
  source 1..20: mol_type = genomic DNA
tttatccatccacacaccca

SEQ ID NO: 212 - DNA, 20 bp, Homo sapiens
  source 1..20: mol_type = genomic DNA
ttatccatccacacacccac

SEQ ID NO: 213 - DNA, 20 bp, Homo sapiens
  source 1..20: mol_type = genomic DNA
tatccatccacacacccacc

SEQ ID NO: 214 - DNA, 20 bp, Homo sapiens
  source 1..20: mol_type = genomic DNA
atccatccacacacccaccc

SEQ ID NO: 215 - DNA, 20 bp, Homo sapiens
  source 1..20: mol_type = genomic DNA
tccatccacacacccaccca

SEQ ID NO: 216 - DNA, 20 bp, Homo sapiens
  source 1..20: mol_type = genomic DNA
ccatccacacacccacccat

SEQ ID NO: 217 - DNA, 20 bp, Homo sapiens
  source 1..20: mol_type = genomic DNA
catccacacacccacccatc

SEQ ID NO: 218 - DNA, 20 bp, Homo sapiens
  source 1..20: mol_type = genomic DNA
atccacacacccacccatct

SEQ ID NO: 219 - DNA, 20 bp, Homo sapiens
  source 1..20: mol_type = genomic DNA
tccacacacccacccatcta

SEQ ID NO: 220 - DNA, 20 bp, Homo sapiens
  source 1..20: mol_type = genomic DNA
ccacacacccacccatctaa

SEQ ID NO: 221 - DNA, 20 bp, Homo sapiens
  source 1..20: mol_type = genomic DNA
cacacacccacccatctaac

SEQ ID NO: 222 - DNA, 20 bp, Homo sapiens
  source 1..20: mol_type = genomic DNA
acacacccacccatctaact

SEQ ID NO: 223 - DNA, 20 bp, Homo sapiens
  source 1..20: mol_type = genomic DNA
cacacccacccatctaacta

SEQ ID NO: 224 - DNA, 20 bp, Homo sapiens
  source 1..20: mol_type = genomic DNA
acacccacccatctaactac

SEQ ID NO: 225 - DNA, 20 bp, Homo sapiens
  source 1..20: mol_type = genomic DNA
cacccacccatctaactacc

SEQ ID NO: 226 - DNA, 20 bp, Homo sapiens
  source 1..20: mol_type = genomic DNA
acccacccatctaactaccc

SEQ ID NO: 227 - DNA, 20 bp, Homo sapiens
  source 1..20: mol_type = genomic DNA
cccacccatctaactacccc

SEQ ID NO: 228 - DNA, 20 bp, Homo sapiens
  source 1..20: mol_type = genomic DNA
ccacccatctaactacccca

SEQ ID NO: 229 - DNA, 20 bp, Homo sapiens
  source 1..20: mol_type = genomic DNA
cacccatctaactaccccaa

SEQ ID NO: 230 - DNA, 20 bp, Homo sapiens
  source 1..20: mol_type = genomic DNA
acccatctaactaccccaaa

SEQ ID NO: 231 - DNA, 20 bp, Homo sapiens
  source 1..20: mol_type = genomic DNA
cccatctaactaccccaaat

SEQ ID NO: 232 - DNA, 20 bp, Homo sapiens
  source 1..20: mol_type = genomic DNA
ccatctaactaccccaaatt

SEQ ID NO: 233 - DNA, 20 bp, Homo sapiens
  source 1..20: mol_type = genomic DNA
aatttcacccatccactctt

SEQ ID NO: 234 - DNA, 20 bp, Homo sapiens
  source 1..20: mol_type = genomic DNA
atttcacccatccactcttc

SEQ ID NO: 235 - DNA, 20 bp, Homo sapiens
  source 1..20: mol_type = genomic DNA
tttcacccatccactcttcc

SEQ ID NO: 236 - DNA, 20 bp, Homo sapiens
  source 1..20: mol_type = genomic DNA
ttcacccatccactcttcca

SEQ ID NO: 237 - DNA, 20 bp, Homo sapiens
  source 1..20: mol_type = genomic DNA
tcacccatccactcttccaa

SEQ ID NO: 238 - DNA, 20 bp, Homo sapiens
  source 1..20: mol_type = genomic DNA
cacccatccactcttccaac

SEQ ID NO: 239 - DNA, 20 bp, Homo sapiens
  source 1..20: mol_type = genomic DNA
acccatccactcttccaacc

SEQ ID NO: 240 - DNA, 20 bp, Homo sapiens
  source 1..20: mol_type = genomic DNA
cccatccactcttccaacct

SEQ ID NO: 241 - DNA, 20 bp, Homo sapiens
  source 1..20: mol_type = genomic DNA
ccatccactcttccaacctt

SEQ ID NO: 242 - DNA, 20 bp, Homo sapiens
  source 1..20: mol_type = genomic DNA
catccactcttccaaccttt

SEQ ID NO: 243 - DNA, 20 bp, Homo sapiens
  source 1..20: mol_type = genomic DNA
atccactcttccaacctttc

SEQ ID NO: 244 - DNA, 20 bp, Homo sapiens
  source 1..20: mol_type = genomic DNA
tccactcttccaacctttca

SEQ ID NO: 245 - DNA, 20 bp, Homo sapiens
  source 1..20: mol_type = genomic DNA
ccactcttccaacctttcag

SEQ ID NO: 246 - DNA, 20 bp, Homo sapiens
  source 1..20: mol_type = genomic DNA
cactcttccaacctttcagt

SEQ ID NO: 247 - DNA, 20 bp, Homo sapiens
  source 1..20: mol_type = genomic DNA
actcttccaacctttcagta

SEQ ID NO: 248 - DNA, 20 bp, Homo sapiens
  source 1..20: mol_type = genomic DNA
ctcttccaacctttcagtaa

SEQ ID NO: 249 - DNA, 20 bp, Homo sapiens
  source 1..20: mol_type = genomic DNA
cctttcagtaattcaaccac

SEQ ID NO: 250 - DNA, 20 bp, Homo sapiens
  source 1..20: mol_type = genomic DNA
cagtaattcaaccacacatc

SEQ ID NO: 251 - DNA, 20 bp, Homo sapiens
  source 1..20: mol_type = genomic DNA
agtaattcaaccacacatcc

SEQ ID NO: 252 - DNA, 20 bp, Homo sapiens
  source 1..20: mol_type = genomic DNA
gtaattcaaccacacatcca

SEQ ID NO: 253 - DNA, 20 bp, Homo sapiens
  source 1..20: mol_type = genomic DNA
aattcaaccacacatccatc

SEQ ID NO: 254 - DNA, 20 bp, Homo sapiens
  source 1..20: mol_type = genomic DNA
attcaaccacacatccatcc

SEQ ID NO: 255 - DNA, 20 bp, Homo sapiens
  source 1..20: mol_type = genomic DNA
ttcaaccacacatccatcca

SEQ ID NO: 256 - DNA, 20 bp, Homo sapiens
  source 1..20: mol_type = genomic DNA
tcaaccacacatccatccat

SEQ ID NO: 257 - DNA, 20 bp, Homo sapiens
  source 1..20: mol_type = genomic DNA
caaccacacatccatccatc

SEQ ID NO: 258 - DNA, 20 bp, Homo sapiens
  source 1..20: mol_type = genomic DNA
aaccacacatccatccatcc

SEQ ID NO: 259 - DNA, 20 bp, Homo sapiens
  source 1..20: mol_type = genomic DNA
accacacatccatccatcca

SEQ ID NO: 260 - DNA, 20 bp, Homo sapiens
  source 1..20: mol_type = genomic DNA
ccacacatccatccatccat

SEQ ID NO: 261 - DNA, 20 bp, Homo sapiens
  source 1..20: mol_type = genomic DNA
cacacatccatccatccatc

SEQ ID NO: 262 - DNA, 20 bp, Homo sapiens
  source 1..20: mol_type = genomic DNA
acacatccatccatccatcc

SEQ ID NO: 263 - DNA, 20 bp, Homo sapiens
  source 1..20: mol_type = genomic DNA
cacatccatccatccatcca

SEQ ID NO: 264 - DNA, 20 bp, Homo sapiens
  source 1..20: mol_type = genomic DNA
acatccatccatccatccat

SEQ ID NO: 265 - DNA, 20 bp, Homo sapiens
  source 1..20: mol_type = genomic DNA
catccatccatccatccatt

SEQ ID NO: 266 - DNA, 20 bp, Homo sapiens
  source 1..20: mol_type = genomic DNA
atccatccatccatccattc

SEQ ID NO: 267 - DNA, 20 bp, Homo sapiens
  source 1..20: mol_type = genomic DNA
tccatccatccatccattca

SEQ ID NO: 268 - DNA, 20 bp, Homo sapiens
  source 1..20: mol_type = genomic DNA
ccatccatccatccattcat

SEQ ID NO: 269 - DNA, 20 bp, Homo sapiens
  source 1..20: mol_type = genomic DNA
catccatccatccattcatc

SEQ ID NO: 270 - DNA, 20 bp, Homo sapiens
  source 1..20: mol_type = genomic DNA
atccatccatccattcatcc

SEQ ID NO: 271 - DNA, 20 bp, Homo sapiens
  source 1..20: mol_type = genomic DNA
tccatccatccattcatcca

SEQ ID NO: 272 - DNA, 20 bp, Homo sapiens
  source 1..20: mol_type = genomic DNA
ccatccatccattcatccat

SEQ ID NO: 273 - DNA, 20 bp, Homo sapiens
  source 1..20: mol_type = genomic DNA
catccatccattcatccatc

SEQ ID NO: 274 - DNA, 20 bp, Homo sapiens
  source 1..20: mol_type = genomic DNA
atccatccattcatccatcc

SEQ ID NO: 275 - DNA, 20 bp, Homo sapiens
  source 1..20: mol_type = genomic DNA
tccatccattcatccatccc

SEQ ID NO: 276 - DNA, 20 bp, Homo sapiens
  source 1..20: mol_type = genomic DNA
ccatccattcatccatccca

SEQ ID NO: 277 - DNA, 20 bp, Homo sapiens
  source 1..20: mol_type = genomic DNA
catccattcatccatcccat

SEQ ID NO: 278 - DNA, 20 bp, Homo sapiens
  source 1..20: mol_type = genomic DNA
atccattcatccatcccata

SEQ ID NO: 279 - DNA, 20 bp, Homo sapiens
  source 1..20: mol_type = genomic DNA
tccattcatccatcccatac

SEQ ID NO: 280 - DNA, 20 bp, Homo sapiens
  source 1..20: mol_type = genomic DNA
ccattcatccatcccataca

SEQ ID NO: 281 - DNA, 20 bp, Homo sapiens
  source 1..20: mol_type = genomic DNA
cattcatccatcccatacat

SEQ ID NO: 282 - DNA, 20 bp, Homo sapiens
  source 1..20: mol_type = genomic DNA
ttcatccatcccatacattg

SEQ ID NO: 283 - DNA, 20 bp, Homo sapiens
  source 1..20: mol_type = genomic DNA
tcatccatcccatacattga

SEQ ID NO: 284 - DNA, 20 bp, Homo sapiens
  source 1..20: mol_type = genomic DNA
catccatcccatacattgat

SEQ ID NO: 285 - DNA, 20 bp, Homo sapiens
  source 1..20: mol_type = genomic DNA
atccatcccatacattgatc

SEQ ID NO: 286 - DNA, 20 bp, Homo sapiens
  source 1..20: mol_type = genomic DNA
tccatcccatacattgatcc

SEQ ID NO: 287 - DNA, 20 bp, Homo sapiens
  source 1..20: mol_type = genomic DNA
gcaacttaatccacctaccc

SEQ ID NO: 288 - DNA, 20 bp, Homo sapiens
  source 1..20: mol_type = genomic DNA
caacttaatccacctaccca

SEQ ID NO: 289 - DNA, 20 bp, Homo sapiens
  source 1..20: mol_type = genomic DNA
aacttaatccacctacccaa

SEQ ID NO: 290 - DNA, 20 bp, Homo sapiens
  source 1..20: mol_type = genomic DNA
acttaatccacctacccaat

SEQ ID NO: 291 - DNA, 20 bp, Homo sapiens
  source 1..20: mol_type = genomic DNA
cttaatccacctacccaatc

SEQ ID NO: 292 - DNA, 20 bp, Homo sapiens
  source 1..20: mol_type = genomic DNA
ttaatccacctacccaatca

SEQ ID NO: 293 - DNA, 20 bp, Homo sapiens
  source 1..20: mol_type = genomic DNA
taatccacctacccaatcat

SEQ ID NO: 294 - DNA, 20 bp, Homo sapiens
  source 1..20: mol_type = genomic DNA
aatccacctacccaatcatt

SEQ ID NO: 295 - DNA, 20 bp, Homo sapiens
  source 1..20: mol_type = genomic DNA
atccacctacccaatcattc

SEQ ID NO: 296 - DNA, 20 bp, Homo sapiens
  source 1..20: mol_type = genomic DNA
tccacctacccaatcattca

SEQ ID NO: 297 - DNA, 20 bp, Homo sapiens
  source 1..20: mol_type = genomic DNA
ccacctacccaatcattcat

SEQ ID NO: 298 - DNA, 20 bp, Homo sapiens
  source 1..20: mol_type = genomic DNA
cacctacccaatcattcatt

SEQ ID NO: 299 - DNA, 20 bp, Homo sapiens
  source 1..20: mol_type = genomic DNA
acctacccaatcattcattc

SEQ ID NO: 300 - DNA, 20 bp, Homo sapiens
  source 1..20: mol_type = genomic DNA
cctacccaatcattcattct

SEQ ID NO: 301 - DNA, 20 bp, Homo sapiens
  source 1..20: mol_type = genomic DNA
ctttcatacaaccaaccatc

SEQ ID NO: 302 - DNA, 20 bp, Homo sapiens
  source 1..20: mol_type = genomic DNA
tttcatacaaccaaccatcc

SEQ ID NO: 303 - DNA, 20 bp, Homo sapiens
  source 1..20: mol_type = genomic DNA
ttcatacaaccaaccatcca

SEQ ID NO: 304 - DNA, 20 bp, Homo sapiens
  source 1..20: mol_type = genomic DNA
tcatacaaccaaccatccat

SEQ ID NO: 305 - DNA, 20 bp, Homo sapiens
  source 1..20: mol_type = genomic DNA
catacaaccaaccatccatc

SEQ ID NO: 306 - DNA, 20 bp, Homo sapiens
  source 1..20: mol_type = genomic DNA
atacaaccaaccatccatcc

SEQ ID NO: 307 - DNA, 20 bp, Homo sapiens
  source 1..20: mol_type = genomic DNA
tacaaccaaccatccatcca

SEQ ID NO: 308 - DNA, 20 bp, Homo sapiens
  source 1..20: mol_type = genomic DNA
acaaccaaccatccatccac

SEQ ID NO: 309 - DNA, 20 bp, Homo sapiens
  source 1..20: mol_type = genomic DNA
caaccaaccatccatccacc

SEQ ID NO: 310 - DNA, 20 bp, Homo sapiens
  source 1..20: mol_type = genomic DNA
aaccaaccatccatccaccc

SEQ ID NO: 311 - DNA, 20 bp, Homo sapiens
  source 1..20: mol_type = genomic DNA
accaaccatccatccaccca

SEQ ID NO: 312 - DNA, 20 bp, Homo sapiens
  source 1..20: mol_type = genomic DNA
ccaaccatccatccacccat

SEQ ID NO: 313 - DNA, 20 bp, Homo sapiens
  source 1..20: mol_type = genomic DNA
caaccatccatccacccatc

SEQ ID NO: 314 - DNA, 20 bp, Homo sapiens
  source 1..20: mol_type = genomic DNA
aaccatccatccacccatca

SEQ ID NO: 315 - DNA, 20 bp, Homo sapiens
  source 1..20: mol_type = genomic DNA
accatccatccacccatcaa

SEQ ID NO: 316 - DNA, 20 bp, Homo sapiens
  source 1..20: mol_type = genomic DNA
ccatccatccacccatcaat

SEQ ID NO: 317 - DNA, 20 bp, Homo sapiens
  source 1..20: mol_type = genomic DNA
catccatccacccatcaatt

SEQ ID NO: 318 - DNA, 20 bp, Homo sapiens
  source 1..20: mol_type = genomic DNA
atccatccacccatcaattt

SEQ ID NO: 319 - DNA, 20 bp, Homo sapiens
  source 1..20: mol_type = genomic DNA
tccatccacccatcaattta

SEQ ID NO: 320 - DNA, 20 bp, Homo sapiens
  source 1..20: mol_type = genomic DNA
ccatccacccatcaatttat

SEQ ID NO: 321 - DNA, 20 bp, Homo sapiens
  source 1..20: mol_type = genomic DNA
catccacccatcaatttatc

SEQ ID NO: 322 - DNA, 20 bp, Homo sapiens
  source 1..20: mol_type = genomic DNA
atccacccatcaatttatcc

SEQ ID NO: 323 - DNA, 20 bp, Homo sapiens
  source 1..20: mol_type = genomic DNA
tccacccatcaatttatcca

SEQ ID NO: 324 - DNA, 20 bp, Homo sapiens
  source 1..20: mol_type = genomic DNA
ccacccatcaatttatccaa

SEQ ID NO: 325 - DNA, 20 bp, Homo sapiens
  source 1..20: mol_type = genomic DNA
cacccatcaatttatccaac

SEQ ID NO: 326 - DNA, 20 bp, Homo sapiens
  source 1..20: mol_type = genomic DNA
acccatcaatttatccaacc

SEQ ID NO: 327 - DNA, 20 bp, Homo sapiens
  source 1..20: mol_type = genomic DNA
cccatcaatttatccaacca

SEQ ID NO: 328 - DNA, 20 bp, Homo sapiens
  source 1..20: mol_type = genomic DNA
atccaaccatccatttttcg

SEQ ID NO: 329 - DNA, 20 bp, Homo sapiens
  source 1..20: mol_type = genomic DNA
tccaaccatccatttttcgt

SEQ ID NO: 330 - DNA, 20 bp, Homo sapiens
  source 1..20: mol_type = genomic DNA
ccaaccatccatttttcgtc

SEQ ID NO: 331 - DNA, 20 bp, Homo sapiens
  source 1..20: mol_type = genomic DNA
caaccatccatttttcgtct

SEQ ID NO: 332 - DNA, 20 bp, Homo sapiens
  source 1..20: mol_type = genomic DNA
aaccatccatttttcgtctg

SEQ ID NO: 333 - DNA, 20 bp, Homo sapiens
  source 1..20: mol_type = genomic DNA
accatccatttttcgtctgt

SEQ ID NO: 334 - DNA, 20 bp, Homo sapiens
  source 1..20: mol_type = genomic DNA
ccatccatttttcgtctgtc

SEQ ID NO: 335 - DNA, 20 bp, Homo sapiens
  source 1..20: mol_type = genomic DNA
catccatttttcgtctgtcc

SEQ ID NO: 336 - DNA, 20 bp, Homo sapiens
  source 1..20: mol_type = genomic DNA
atccatttttcgtctgtcca

SEQ ID NO: 337 - DNA, 20 bp, Homo sapiens
  source 1..20: mol_type = genomic DNA
tccatttttcgtctgtccac

SEQ ID NO: 338 - DNA, 20 bp, Homo sapiens
  source 1..20: mol_type = genomic DNA
ccatttttcgtctgtccacc

SEQ ID NO: 339 - DNA, 20 bp, Homo sapiens
  source 1..20: mol_type = genomic DNA
catttttcgtctgtccacca

SEQ ID NO: 340 - DNA, 20 bp, Homo sapiens
  source 1..20: mol_type = genomic DNA
atttttcgtctgtccaccag

SEQ ID NO: 341 - DNA, 20 bp, Homo sapiens
  source 1..20: mol_type = genomic DNA
tttttcgtctgtccaccagc

SEQ ID NO: 342 - DNA, 20 bp, Homo sapiens
  source 1..20: mol_type = genomic DNA
ttttcgtctgtccaccagcc

SEQ ID NO: 343 - DNA, 20 bp, Homo sapiens
  source 1..20: mol_type = genomic DNA
tttcgtctgtccaccagcca

SEQ ID NO: 344 - DNA, 20 bp, Homo sapiens
  source 1..20: mol_type = genomic DNA
ttcgtctgtccaccagccac

SEQ ID NO: 345 - DNA, 20 bp, Homo sapiens
  source 1..20: mol_type = genomic DNA
tcgtctgtccaccagccact

SEQ ID NO: 346 - DNA, 20 bp, Homo sapiens
  source 1..20: mol_type = genomic DNA
gtctgtccaccagccactca

SEQ ID NO: 347 - DNA, 20 bp, Homo sapiens
  source 1..20: mol_type = genomic DNA
tctgtccaccagccactcac

SEQ ID NO: 348 - DNA, 20 bp, Homo sapiens
  source 1..20: mol_type = genomic DNA
ctgtccaccagccactcaca

SEQ ID NO: 349 - DNA, 20 bp, Homo sapiens
  source 1..20: mol_type = genomic DNA
tgtccaccagccactcacaa

SEQ ID NO: 350 - DNA, 20 bp, Homo sapiens
  source 1..20: mol_type = genomic DNA
gtccaccagccactcacaac

SEQ ID NO: 351 - DNA, 20 bp, Homo sapiens
  source 1..20: mol_type = genomic DNA
tccaccagccactcacaacc

SEQ ID NO: 352 - DNA, 20 bp, Homo sapiens
  source 1..20: mol_type = genomic DNA
ccaccagccactcacaacca

SEQ ID NO: 353 - DNA, 20 bp, Homo sapiens
  source 1..20: mol_type = genomic DNA
caccagccactcacaaccat

SEQ ID NO: 354 - DNA, 20 bp, Homo sapiens
  source 1..20: mol_type = genomic DNA
accagccactcacaaccatc

SEQ ID NO: 355 - DNA, 20 bp, Homo sapiens
  source 1..20: mol_type = genomic DNA
ccagccactcacaaccatcc

SEQ ID NO: 356 - DNA, 20 bp, Homo sapiens
  source 1..20: mol_type = genomic DNA
cagccactcacaaccatcca

SEQ ID NO: 357 - DNA, 20 bp, Homo sapiens
  source 1..20: mol_type = genomic DNA
agccactcacaaccatccat

SEQ ID NO: 358 - DNA, 20 bp, Homo sapiens
  source 1..20: mol_type = genomic DNA
gccactcacaaccatccatc

SEQ ID NO: 359 - DNA, 20 bp, Homo sapiens
  source 1..20: mol_type = genomic DNA
ccactcacaaccatccatct

SEQ ID NO: 360 - DNA, 20 bp, Homo sapiens
  source 1..20: mol_type = genomic DNA
cactcacaaccatccatcta

SEQ ID NO: 361 - DNA, 20 bp, Homo sapiens
  source 1..20: mol_type = genomic DNA
actcacaaccatccatctaa

SEQ ID NO: 362 - DNA, 20 bp, Homo sapiens
  source 1..20: mol_type = genomic DNA
ctcacaaccatccatctaaa

SEQ ID NO: 363 - DNA, 20 bp, Homo sapiens
  source 1..20: mol_type = genomic DNA
gcaatagttcaaccacacat

SEQ ID NO: 364 - DNA, 20 bp, Homo sapiens
  source 1..20: mol_type = genomic DNA
caatagttcaaccacacatc

SEQ ID NO: 365 - DNA, 20 bp, Homo sapiens
  source 1..20: mol_type = genomic DNA
aatagttcaaccacacatcc

SEQ ID NO: 366 - DNA, 20 bp, Homo sapiens
  source 1..20: mol_type = genomic DNA
atagttcaaccacacatcct

SEQ ID NO: 367 - DNA, 20 bp, Homo sapiens
  source 1..20: mol_type = genomic DNA
tagttcaaccacacatcctt

SEQ ID NO: 368 - DNA, 20 bp, Homo sapiens
  source 1..20: mol_type = genomic DNA
agttcaaccacacatccttc

SEQ ID NO: 369 - DNA, 20 bp, Homo sapiens
  source 1..20: mol_type = genomic DNA
gttcaaccacacatccttcc

SEQ ID NO: 370 - DNA, 20 bp, Homo sapiens
  source 1..20: mol_type = genomic DNA
ttcaaccacacatccttcca

SEQ ID NO: 371 - DNA, 20 bp, Homo sapiens
  source 1..20: mol_type = genomic DNA
tcaaccacacatccttccat

SEQ ID NO: 372 - DNA, 20 bp, Homo sapiens
  source 1..20: mol_type = genomic DNA
caaccacacatccttccatt

SEQ ID NO: 373 - DNA, 20 bp, Homo sapiens
  source 1..20: mol_type = genomic DNA
aaccacacatccttccattc

SEQ ID NO: 374 - DNA, 20 bp, Homo sapiens
  source 1..20: mol_type = genomic DNA
accacacatccttccattca

SEQ ID NO: 375 - DNA, 20 bp, Homo sapiens
  source 1..20: mol_type = genomic DNA
ccacacatccttccattcat

SEQ ID NO: 376 - DNA, 20 bp, Homo sapiens
  source 1..20: mol_type = genomic DNA
cacacatccttccattcatc

SEQ ID NO: 377 - DNA, 20 bp, Homo sapiens
  source 1..20: mol_type = genomic DNA
acacatccttccattcatcc

SEQ ID NO: 378 - DNA, 20 bp, Homo sapiens
  source 1..20: mol_type = genomic DNA
cacatccttccattcatcca

SEQ ID NO: 379 - DNA, 20 bp, Homo sapiens
  source 1..20: mol_type = genomic DNA
acatccttccattcatccac

SEQ ID NO: 380 - DNA, 20 bp, Homo sapiens
  source 1..20: mol_type = genomic DNA
catccttccattcatccacc

SEQ ID NO: 381 - DNA, 20 bp, Homo sapiens
  source 1..20: mol_type = genomic DNA
atccttccattcatccaccc

SEQ ID NO: 382 - DNA, 20 bp, Homo sapiens
  source 1..20: mol_type = genomic DNA
tccttccattcatccaccca

SEQ ID NO: 383 - DNA, 20 bp, Homo sapiens
  source 1..20: mol_type = genomic DNA
ccttccattcatccacccac

SEQ ID NO: 384 - DNA, 20 bp, Homo sapiens
  source 1..20: mol_type = genomic DNA
cttccattcatccacccacc

SEQ ID NO: 385 - DNA, 20 bp, Homo sapiens
  source 1..20: mol_type = genomic DNA
ttccattcatccacccaccc

SEQ ID NO: 386 - DNA, 20 bp, Homo sapiens
  source 1..20: mol_type = genomic DNA
tccattcatccacccaccca

SEQ ID NO: 387 - DNA, 20 bp, Homo sapiens
  source 1..20: mol_type = genomic DNA
cattcatccacccacccatt

SEQ ID NO: 388 - DNA, 20 bp, Homo sapiens
  source 1..20: mol_type = genomic DNA
attcatccacccacccattc

SEQ ID NO: 389 - DNA, 20 bp, Homo sapiens
  source 1..20: mol_type = genomic DNA
ttcatccacccacccattca

SEQ ID NO: 390 - DNA, 20 bp, Homo sapiens
  source 1..20: mol_type = genomic DNA
tcatccacccacccattcat

SEQ ID NO: 391 - DNA, 20 bp, Homo sapiens
  source 1..20: mol_type = genomic DNA
catccacccacccattcatc

SEQ ID NO: 392 - DNA, 20 bp, Homo sapiens
  source 1..20: mol_type = genomic DNA
atccacccacccattcatcc

SEQ ID NO: 393 - DNA, 20 bp, Homo sapiens
  source 1..20: mol_type = genomic DNA
tccacccacccattcatcca

SEQ ID NO: 394 - DNA, 20 bp, Homo sapiens
  source 1..20: mol_type = genomic DNA
ccacccacccattcatccat

SEQ ID NO: 395 - DNA, 20 bp, Homo sapiens
  source 1..20: mol_type = genomic DNA
cacccacccattcatccatt

SEQ ID NO: 396 - DNA, 20 bp, Homo sapiens
  source 1..20: mol_type = genomic DNA
acccacccattcatccattt

SEQ ID NO: 397 - DNA, 20 bp, Homo sapiens
  source 1..20: mol_type = genomic DNA
cccacccattcatccatttg

SEQ ID NO: 398 - DNA, 20 bp, Homo sapiens
  source 1..20: mol_type = genomic DNA
ccacccattcatccatttgt

SEQ ID NO: 399 - DNA, 20 bp, Homo sapiens
  source 1..20: mol_type = genomic DNA
cacccattcatccatttgtc

SEQ ID NO: 400 - DNA, 20 bp, Homo sapiens
  source 1..20: mol_type = genomic DNA
acccattcatccatttgtcc

SEQ ID NO: 401 - DNA, 20 bp, Homo sapiens
  source 1..20: mol_type = genomic DNA
ccattcatccatttgtccat

SEQ ID NO: 402 - DNA, 20 bp, Homo sapiens
  source 1..20: mol_type = genomic DNA
cattcatccatttgtccatc

SEQ ID NO: 403 - DNA, 20 bp, Homo sapiens
  source 1..20: mol_type = genomic DNA
ttcatccatttgtccatctg

SEQ ID NO: 404 - DNA, 20 bp, Homo sapiens
  source 1..20: mol_type = genomic DNA
tcatccatttgtccatctgc

SEQ ID NO: 405 - DNA, 20 bp, Homo sapiens
  source 1..20: mol_type = genomic DNA
catccatttgtccatctgcc

SEQ ID NO: 406 - DNA, 20 bp, Homo sapiens
  source 1..20: mol_type = genomic DNA
atccatttgtccatctgcct

SEQ ID NO: 407 - DNA, 20 bp, Homo sapiens
  source 1..20: mol_type = genomic DNA
tccatttgtccatctgccta

SEQ ID NO: 408 - DNA, 20 bp, Homo sapiens
  source 1..20: mol_type = genomic DNA
ccatttgtccatctgcctat

SEQ ID NO: 409 - DNA, 20 bp, Homo sapiens
  source 1..20: mol_type = genomic DNA
catttgtccatctgcctata

SEQ ID NO: 410 - DNA, 20 bp, Homo sapiens
  source 1..20: mol_type = genomic DNA
atttgtccatctgcctatac

SEQ ID NO: 411 - DNA, 20 bp, Homo sapiens
  source 1..20: mol_type = genomic DNA
tttgtccatctgcctataca

SEQ ID NO: 412 - DNA, 20 bp, Homo sapiens
  source 1..20: mol_type = genomic DNA
ttgtccatctgcctatacat

SEQ ID NO: 413 - DNA, 20 bp, Homo sapiens
  source 1..20: mol_type = genomic DNA
tgtccatctgcctatacatc

SEQ ID NO: 414 - DNA, 20 bp, Homo sapiens
  source 1..20: mol_type = genomic DNA
gtccatctgcctatacatcc

SEQ ID NO: 415 - DNA, 20 bp, Homo sapiens
  source 1..20: mol_type = genomic DNA
tccatctgcctatacatcca

SEQ ID NO: 416 - DNA, 20 bp, Homo sapiens
  source 1..20: mol_type = genomic DNA
ccatctgcctatacatccat

SEQ ID NO: 417 - DNA, 20 bp, Homo sapiens
  source 1..20: mol_type = genomic DNA
catctgcctatacatccatc

SEQ ID NO: 418 - DNA, 20 bp, Homo sapiens
  source 1..20: mol_type = genomic DNA
atctgcctatacatccatcc

SEQ ID NO: 419 - DNA, 20 bp, Homo sapiens
  source 1..20: mol_type = genomic DNA
tctgcctatacatccatcca

SEQ ID NO: 420 - DNA, 20 bp, Homo sapiens
  source 1..20: mol_type = genomic DNA
ctgcctatacatccatccat

SEQ ID NO: 421 - DNA, 20 bp, Homo sapiens
  source 1..20: mol_type = genomic DNA
tgcctatacatccatccatc

SEQ ID NO: 422 - DNA, 20 bp, Homo sapiens
  source 1..20: mol_type = genomic DNA
gcctatacatccatccatcc

SEQ ID NO: 423 - DNA, 20 bp, Homo sapiens
  source 1..20: mol_type = genomic DNA
cctatacatccatccatcca

SEQ ID NO: 424 - DNA, 20 bp, Homo sapiens
  source 1..20: mol_type = genomic DNA
ctatacatccatccatccat

SEQ ID NO: 425 - DNA, 20 bp, Homo sapiens
  source 1..20: mol_type = genomic DNA
tatacatccatccatccatc

SEQ ID NO: 426 - DNA, 20 bp, Homo sapiens
  source 1..20: mol_type = genomic DNA
atacatccatccatccatcc

SEQ ID NO: 427 - DNA, 20 bp, Homo sapiens
  source 1..20: mol_type = genomic DNA
tacatccatccatccatcca

SEQ ID NO: 428 - DNA, 20 bp, Homo sapiens
  source 1..20: mol_type = genomic DNA
acatccatccatccatccat

SEQ ID NO: 429 - DNA, 20 bp, Homo sapiens
  source 1..20: mol_type = genomic DNA
catccatccatccatccatc

SEQ ID NO: 430 - DNA, 20 bp, Homo sapiens
  source 1..20: mol_type = genomic DNA
atccatccatccatccatcc

SEQ ID NO: 431 - DNA, 20 bp, Homo sapiens
  source 1..20: mol_type = genomic DNA
tccatccatccatccatcca

SEQ ID NO: 432 - DNA, 20 bp, Homo sapiens
  source 1..20: mol_type = genomic DNA
ccatccatccatccatccat

SEQ ID NO: 433 - DNA, 20 bp, Homo sapiens
  source 1..20: mol_type = genomic DNA
catccatccatccatccatc

SEQ ID NO: 434 - DNA, 20 bp, Homo sapiens
  source 1..20: mol_type = genomic DNA
atccatccatccatccatct

SEQ ID NO: 435 - DNA, 20 bp, Homo sapiens
  source 1..20: mol_type = genomic DNA
tccatccatccatccatcta

SEQ ID NO: 436 - DNA, 20 bp, Homo sapiens
  source 1..20: mol_type = genomic DNA
ccatccatccatccatctac

SEQ ID NO: 437 - DNA, 20 bp, Homo sapiens
  source 1..20: mol_type = genomic DNA
catccatccatccatctacc

SEQ ID NO: 438 - DNA, 20 bp, Homo sapiens
  source 1..20: mol_type = genomic DNA
atccatccatccatctacct

SEQ ID NO: 439 - DNA, 20 bp, Homo sapiens
  source 1..20: mol_type = genomic DNA
tccatccatccatctaccta

SEQ ID NO: 440 - DNA, 20 bp, Homo sapiens
  source 1..20: mol_type = genomic DNA
ccatccatccatctacctat

SEQ ID NO: 441 - DNA, 20 bp, Homo sapiens
  source 1..20: mol_type = genomic DNA
catccatccatctacctatc

SEQ ID NO: 442 - DNA, 20 bp, Homo sapiens
  source 1..20: mol_type = genomic DNA
atccatccatctacctatct

SEQ ID NO: 443 - DNA, 20 bp, Homo sapiens
  source 1..20: mol_type = genomic DNA
tccatccatctacctatcta

SEQ ID NO: 444 - DNA, 20 bp, Homo sapiens
  source 1..20: mol_type = genomic DNA
ccatccatctacctatctac

SEQ ID NO: 445 - DNA, 20 bp, Homo sapiens
  source 1..20: mol_type = genomic DNA
catccatctacctatctacc

SEQ ID NO: 446 - DNA, 20 bp, Homo sapiens
  source 1..20: mol_type = genomic DNA
atccatctacctatctaccc

SEQ ID NO: 447 - DNA, 20 bp, Homo sapiens
  source 1..20: mol_type = genomic DNA
tccatctacctatctaccca

SEQ ID NO: 448 - DNA, 20 bp, Homo sapiens
  source 1..20: mol_type = genomic DNA
ccatctacctatctacccat

SEQ ID NO: 449 - DNA, 20 bp, Homo sapiens
  source 1..20: mol_type = genomic DNA
catctacctatctacccatc

SEQ ID NO: 450 - DNA, 20 bp, Homo sapiens
  source 1..20: mol_type = genomic DNA
atctacctatctacccatct

SEQ ID NO: 451 - DNA, 20 bp, Homo sapiens
  source 1..20: mol_type = genomic DNA
tctacctatctacccatctg

SEQ ID NO: 452 - DNA, 20 bp, Homo sapiens
  source 1..20: mol_type = genomic DNA
ctacctatctacccatctga

SEQ ID NO: 453 - DNA, 20 bp, Homo sapiens
  source 1..20: mol_type = genomic DNA
tacctatctacccatctgac

SEQ ID NO: 454 - DNA, 20 bp, Homo sapiens
  source 1..20: mol_type = genomic DNA
acctatctacccatctgact

SEQ ID NO: 455 - DNA, 20 bp, Homo sapiens
  source 1..20: mol_type = genomic DNA
cctatctacccatctgacta

SEQ ID NO: 456 - DNA, 20 bp, Homo sapiens
  source 1..20: mol_type = genomic DNA
ctatctacccatctgactat

SEQ ID NO: 457 - DNA, 20 bp, Homo sapiens
  source 1..20: mol_type = genomic DNA
tatctacccatctgactatc

SEQ ID NO: 458 - DNA, 20 bp, Homo sapiens
  source 1..20: mol_type = genomic DNA
atctacccatctgactatca

SEQ ID NO: 459 - DNA, 20 bp, Homo sapiens
  source 1..20: mol_type = genomic DNA
tctacccatctgactatcaa

SEQ ID NO: 460 - DNA, 20 bp, Homo sapiens
  source 1..20: mol_type = genomic DNA
ctacccatctgactatcaac

SEQ ID NO: 461 - DNA, 20 bp, Homo sapiens
  source 1..20: mol_type = genomic DNA
tacccatctgactatcaaca

SEQ ID NO: 462 - DNA, 20 bp, Homo sapiens
  source 1..20: mol_type = genomic DNA
acccatctgactatcaacaa

SEQ ID NO: 463 - DNA, 20 bp, Homo sapiens
  source 1..20: mol_type = genomic DNA
cccatctgactatcaacaaa

SEQ ID NO: 464 - DNA, 20 bp, Homo sapiens
  source 1..20: mol_type = genomic DNA
cacctatctactcaatcttc

SEQ ID NO: 465 - DNA, 20 bp, Homo sapiens
  source 1..20: mol_type = genomic DNA
acctatctactcaatcttcc

SEQ ID NO: 466 - DNA, 20 bp, Homo sapiens
  source 1..20: mol_type = genomic DNA
cctatctactcaatcttcct

SEQ ID NO: 467 - DNA, 20 bp, Homo sapiens
  source 1..20: mol_type = genomic DNA
ccttctaataactcaaccac

SEQ ID NO: 468 - DNA, 20 bp, Homo sapiens
  source 1..20: mol_type = genomic DNA
aataactcaaccacacttcc

SEQ ID NO: 469 - DNA, 20 bp, Homo sapiens
  source 1..20: mol_type = genomic DNA
ataactcaaccacacttcca

SEQ ID NO: 470 - DNA, 20 bp, Homo sapiens
  source 1..20: mol_type = genomic DNA
taactcaaccacacttccat

SEQ ID NO: 471 - DNA, 20 bp, Homo sapiens
  source 1..20: mol_type = genomic DNA
aactcaaccacacttccatc

SEQ ID NO: 472 - DNA, 20 bp, Homo sapiens
  source 1..20: mol_type = genomic DNA
actcaaccacacttccatcc

SEQ ID NO: 473 - DNA, 20 bp, Homo sapiens
  source 1..20: mol_type = genomic DNA
ctcaaccacacttccatcca

SEQ ID NO: 474 - DNA, 20 bp, Homo sapiens
  source 1..20: mol_type = genomic DNA
tcaaccacacttccatccat

SEQ ID NO: 475 - DNA, 20 bp, Homo sapiens
  source 1..20: mol_type = genomic DNA
caaccacacttccatccatc

SEQ ID NO: 476 - DNA, 20 bp, Homo sapiens
  source 1..20: mol_type = genomic DNA
aaccacacttccatccatcc

SEQ ID NO: 477 - DNA, 20 bp, Homo sapiens
  source 1..20: mol_type = genomic DNA
accacacttccatccatccc

SEQ ID NO: 478 - DNA, 20 bp, Homo sapiens
  source 1..20: mol_type = genomic DNA
ccacacttccatccatccca

SEQ ID NO: 479 - DNA, 20 bp, Homo sapiens
  source 1..20: mol_type = genomic DNA
cacacttccatccatcccat

SEQ ID NO: 480 - DNA, 20 bp, Homo sapiens
  source 1..20: mol_type = genomic DNA
acacttccatccatcccatc

SEQ ID NO: 481 - DNA, 20 bp, Homo sapiens
  source 1..20: mol_type = genomic DNA
cacttccatccatcccatcc

SEQ ID NO: 482 - DNA, 20 bp, Homo sapiens
  source 1..20: mol_type = genomic DNA
acttccatccatcccatcca

SEQ ID NO: 483 - DNA, 20 bp, Homo sapiens
  source 1..20: mol_type = genomic DNA
cttccatccatcccatccaa

SEQ ID NO: 484 - DNA, 20 bp, Homo sapiens
  source 1..20: mol_type = genomic DNA
ttccatccatcccatccaat

SEQ ID NO: 485 - DNA, 20 bp, Homo sapiens
  source 1..20: mol_type = genomic DNA
tccatccatcccatccaata

SEQ ID NO: 486 - DNA, 20 bp, Homo sapiens
  source 1..20: mol_type = genomic DNA
ccatccatcccatccaatac

SEQ ID NO: 487 - DNA, 20 bp, Homo sapiens
  source 1..20: mol_type = genomic DNA
catccatcccatccaataca

SEQ ID NO: 488 - DNA, 20 bp, Homo sapiens
  source 1..20: mol_type = genomic DNA
atccatcccatccaatacaa

SEQ ID NO: 489 - DNA, 20 bp, Homo sapiens
  source 1..20: mol_type = genomic DNA
tccatcccatccaatacaac

SEQ ID NO: 490 - DNA, 20 bp, Homo sapiens
  source 1..20: mol_type = genomic DNA
ccatcccatccaatacaact

SEQ ID NO: 491 - DNA, 20 bp, Homo sapiens
  source 1..20: mol_type = genomic DNA
catcccatccaatacaactt

SEQ ID NO: 492 - DNA, 20 bp, Homo sapiens
  source 1..20: mol_type = genomic DNA
acaacttaatctgctcatcc

SEQ ID NO: 493 - DNA, 20 bp, Homo sapiens
  source 1..20: mol_type = genomic DNA
caacttaatctgctcatcca

SEQ ID NO: 494 - DNA, 20 bp, Homo sapiens
  source 1..20: mol_type = genomic DNA
acttaatctgctcatccaac

SEQ ID NO: 495 - DNA, 20 bp, Homo sapiens
  source 1..20: mol_type = genomic DNA
cttaatctgctcatccaaca

SEQ ID NO: 496 - DNA, 20 bp, Homo sapiens
  source 1..20: mol_type = genomic DNA
atctgctcatccaacatttc

SEQ ID NO: 497 - DNA, 20 bp, Homo sapiens
  source 1..20: mol_type = genomic DNA
tctgctcatccaacatttca

SEQ ID NO: 498 - DNA, 20 bp, Homo sapiens
  source 1..20: mol_type = genomic DNA
ctgctcatccaacatttcat

SEQ ID NO: 499 - DNA, 20 bp, Homo sapiens
  source 1..20: mol_type = genomic DNA
tgctcatccaacatttcatc

SEQ ID NO: 500 - DNA, 20 bp, Homo sapiens
  source 1..20: mol_type = genomic DNA
gctcatccaacatttcatct

SEQ ID NO: 501 - DNA, 20 bp, Homo sapiens
  source 1..20: mol_type = genomic DNA
ccaacatttcatctatccac

SEQ ID NO: 502 - DNA, 20 bp, Homo sapiens
  source 1..20: mol_type = genomic DNA
caacatttcatctatccacc

SEQ ID NO: 503 - DNA, 20 bp, Homo sapiens
  source 1..20: mol_type = genomic DNA
aacatttcatctatccaccc

SEQ ID NO: 504 - DNA, 20 bp, Homo sapiens
  source 1..20: mol_type = genomic DNA
acatttcatctatccaccca

SEQ ID NO: 505 - DNA, 20 bp, Homo sapiens
  source 1..20: mol_type = genomic DNA
catttcatctatccacccag

SEQ ID NO: 506 - DNA, 20 bp, Homo sapiens
  source 1..20: mol_type = genomic DNA
atttcatctatccacccagt

SEQ ID NO: 507 - DNA, 20 bp, Homo sapiens
  source 1..20: mol_type = genomic DNA
tttcatctatccacccagtc

SEQ ID NO: 508 - DNA, 20 bp, Homo sapiens
  source 1..20: mol_type = genomic DNA
ttcatctatccacccagtca

SEQ ID NO: 509 - DNA, 20 bp, Homo sapiens
  source 1..20: mol_type = genomic DNA
tcatctatccacccagtcaa

SEQ ID NO: 510 - DNA, 20 bp, Homo sapiens
  source 1..20: mol_type = genomic DNA
catctatccacccagtcaat

SEQ ID NO: 511 - DNA, 20 bp, Homo sapiens
  source 1..20: mol_type = genomic DNA
atctatccacccagtcaatc

SEQ ID NO: 512 - DNA, 20 bp, Homo sapiens
  source 1..20: mol_type = genomic DNA
tctatccacccagtcaatca

SEQ ID NO: 513 - DNA, 20 bp, Homo sapiens
  source 1..20: mol_type = genomic DNA
ctatccacccagtcaatcat

SEQ ID NO: 514 - DNA, 20 bp, Homo sapiens
  source 1..20: mol_type = genomic DNA
tatccacccagtcaatcatc

SEQ ID NO: 515 - DNA, 20 bp, Homo sapiens
  source 1..20: mol_type = genomic DNA
atccacccagtcaatcatct

SEQ ID NO: 516 - DNA, 20 bp, Homo sapiens
  source 1..20: mol_type = genomic DNA
tccacccagtcaatcatcta

SEQ ID NO: 517 - DNA, 20 bp, Homo sapiens
  source 1..20: mol_type = genomic DNA
ccacccagtcaatcatctat

SEQ ID NO: 518 - DNA, 20 bp, Homo sapiens
  source 1..20: mol_type = genomic DNA
cacccagtcaatcatctatc

SEQ ID NO: 519 - DNA, 20 bp, Homo sapiens
  source 1..20: mol_type = genomic DNA
acccagtcaatcatctatcc

SEQ ID NO: 520 - DNA, 20 bp, Homo sapiens
  source 1..20: mol_type = genomic DNA
cccagtcaatcatctatcca

SEQ ID NO: 521 - DNA, 20 bp, Homo sapiens
  source 1..20: mol_type = genomic DNA
ccagtcaatcatctatccag

SEQ ID NO: 522 - DNA, 20 bp, Homo sapiens
  source 1..20: mol_type = genomic DNA
cagtcaatcatctatccagc

SEQ ID NO: 523 - DNA, 20 bp, Homo sapiens
  source 1..20: mol_type = genomic DNA
agtcaatcatctatccagca

SEQ ID NO: 524 - DNA, 20 bp, Homo sapiens
  source 1..20: mol_type = genomic DNA
gtcaatcatctatccagcaa

SEQ ID NO: 525 - DNA, 20 bp, Homo sapiens
  source 1..20: mol_type = genomic DNA
caatcatctatccagcaatc

SEQ ID NO: 526 - DNA, 20 bp, Homo sapiens
  source 1..20: mol_type = genomic DNA
catctatccagcaatctatc

SEQ ID NO: 527 - DNA, 20 bp, Homo sapiens
  source 1..20: mol_type = genomic DNA
atccagcaatctatctatcc

SEQ ID NO: 528 - DNA, 20 bp, Homo sapiens
  source 1..20: mol_type = genomic DNA
tccagcaatctatctatcca

SEQ ID NO: 529 - DNA, 20 bp, Homo sapiens
  source 1..20: mol_type = genomic DNA
ccagcaatctatctatccac

SEQ ID NO: 530 - DNA, 20 bp, Homo sapiens
  source 1..20: mol_type = genomic DNA
cagcaatctatctatccact

SEQ ID NO: 531 - DNA, 20 bp, Homo sapiens
  source 1..20: mol_type = genomic DNA
agcaatctatctatccactc

SEQ ID NO: 532 - DNA, 20 bp, Homo sapiens
  source 1..20: mol_type = genomic DNA
gcaatctatctatccactca

SEQ ID NO: 533 - DNA, 20 bp, Homo sapiens
  source 1..20: mol_type = genomic DNA
ctatctatccactcatcaag

SEQ ID NO: 534 - DNA, 20 bp, Homo sapiens
  source 1..20: mol_type = genomic DNA
atccactcatcaagttatcc

SEQ ID NO: 535 - DNA, 20 bp, Homo sapiens
  source 1..20: mol_type = genomic DNA
tccactcatcaagttatcca

SEQ ID NO: 536 - DNA, 20 bp, Homo sapiens
  source 1..20: mol_type = genomic DNA
ccactcatcaagttatccat

SEQ ID NO: 537 - DNA, 20 bp, Homo sapiens
  source 1..20: mol_type = genomic DNA
cactcatcaagttatccatc

SEQ ID NO: 538 - DNA, 20 bp, Homo sapiens
  source 1..20: mol_type = genomic DNA
actcatcaagttatccatcc

SEQ ID NO: 539 - DNA, 20 bp, Homo sapiens
  source 1..20: mol_type = genomic DNA
ctcatcaagttatccatcca

SEQ ID NO: 540 - DNA, 20 bp, Homo sapiens
  source 1..20: mol_type = genomic DNA
catcaagttatccatccatc

SEQ ID NO: 541 - DNA, 20 bp, Homo sapiens
  source 1..20: mol_type = genomic DNA
ccatcatctaacaattaccc

SEQ ID NO: 542 - DNA, 20 bp, Homo sapiens
  source 1..20: mol_type = genomic DNA
catcatctaacaattacccc

SEQ ID NO: 543 - DNA, 20 bp, Homo sapiens
  source 1..20: mol_type = genomic DNA
atcatctaacaattaccccc

SEQ ID NO: 544 - DNA, 20 bp, Homo sapiens
  source 1..20: mol_type = genomic DNA
tcatctaacaattaccccca

SEQ ID NO: 545 - DNA, 20 bp, Homo sapiens
  source 1..20: mol_type = genomic DNA
catctaacaattacccccaa

SEQ ID NO: 546 - DNA, 20 bp, Homo sapiens
  source 1..20: mol_type = genomic DNA
acaattacccccaaattcac

SEQ ID NO: 547 - DNA, 20 bp, Homo sapiens
  source 1..20: mol_type = genomic DNA
caattacccccaaattcacc

SEQ ID NO: 548 - DNA, 20 bp, Homo sapiens
  source 1..20: mol_type = genomic DNA
ccatcccatacattgatccg

SEQ ID NO: 549 - DNA, 20 bp, Homo sapiens
  source 1..20: mol_type = genomic DNA
catcccatacattgatccgc

SEQ ID NO: 550 - DNA, 20 bp, Homo sapiens
  source 1..20: mol_type = genomic DNA
atcccatacattgatccgca

SEQ ID NO: 551 - DNA, 20 bp, Homo sapiens
  source 1..20: mol_type = genomic DNA
tcccatacattgatccgcaa

SEQ ID NO: 552 - DNA, 20 bp, Homo sapiens
  source 1..20: mol_type = genomic DNA
cccatacattgatccgcaac

SEQ ID NO: 553 - DNA, 20 bp, Homo sapiens
  source 1..20: mol_type = genomic DNA
ccatacattgatccgcaact

SEQ ID NO: 554 - DNA, 20 bp, Homo sapiens
  source 1..20: mol_type = genomic DNA
catacattgatccgcaactt

SEQ ID NO: 555 - DNA, 20 bp, Homo sapiens
  source 1..20: mol_type = genomic DNA
cattgatccgcaacttaatc

SEQ ID NO: 556 - DNA, 20 bp, Homo sapiens
  source 1..20: mol_type = genomic DNA
attgatccgcaacttaatcc

SEQ ID NO: 557 - DNA, 20 bp, Homo sapiens
  source 1..20: mol_type = genomic DNA
ttgatccgcaacttaatcca

SEQ ID NO: 558 - DNA, 20 bp, Homo sapiens
  source 1..20: mol_type = genomic DNA
tgatccgcaacttaatccac

SEQ ID NO: 559 - DNA, 20 bp, Homo sapiens
  source 1..20: mol_type = genomic DNA
gatccgcaacttaatccacc

SEQ ID NO: 560 - DNA, 20 bp, Homo sapiens
  source 1..20: mol_type = genomic DNA
atccgcaacttaatccacct

SEQ ID NO: 561 - DNA, 20 bp, Homo sapiens
  source 1..20: mol_type = genomic DNA
tccgcaacttaatccaccta

SEQ ID NO: 562 - DNA, 20 bp, Homo sapiens
  source 1..20: mol_type = genomic DNA
ccgcaacttaatccacctac

SEQ ID NO: 563 - DNA, 20 bp, Homo sapiens
  source 1..20: mol_type = genomic DNA
cgcaacttaatccacctacc

SEQ ID NO: 564 - DNA, 20 bp, Homo sapiens
  source 1..20: mol_type = genomic DNA
ccattcatccacccacccat

SEQ ID NO: 565 - DNA, 20 bp, Homo sapiens
  source 1..20: mol_type = genomic DNA
cccattcatccatttgtcca

SEQ ID NO: 566 - DNA, 20 bp, Homo sapiens
  source 1..20: mol_type = genomic DNA
ccatcatccatctagccacg

SEQ ID NO: 567 - DNA, 20 bp, Homo sapiens
  source 1..20: mol_type = genomic DNA
catcatccatctagccacga

SEQ ID NO: 568 - DNA, 20 bp, Homo sapiens
  source 1..20: mol_type = genomic DNA
atcatccatctagccacgaa

SEQ ID NO: 569 - DNA, 20 bp, Homo sapiens
  source 1..20: mol_type = genomic DNA
tcatccatctagccacgaat

SEQ ID NO: 570 - DNA, 20 bp, Homo sapiens
  source 1..20: mol_type = genomic DNA
catccatctagccacgaatc

SEQ ID NO: 571 - DNA, 20 bp, Homo sapiens
  source 1..20: mol_type = genomic DNA
atccatctagccacgaatct

SEQ ID NO: 572 - DNA, 20 bp, Homo sapiens
  source 1..20: mol_type = genomic DNA
tccatctagccacgaatcta

SEQ ID NO: 573 - DNA, 20 bp, Homo sapiens
  source 1..20: mol_type = genomic DNA
ccatctagccacgaatctac

SEQ ID NO: 574 - DNA, 20 bp, Homo sapiens
  source 1..20: mol_type = genomic DNA
catctagccacgaatctacc

SEQ ID NO: 575 - DNA, 20 bp, Homo sapiens
  source 1..20: mol_type = genomic DNA
atctagccacgaatctaccc

SEQ ID NO: 576 - DNA, 20 bp, Homo sapiens
  source 1..20: mol_type = genomic DNA
tctagccacgaatctaccca

SEQ ID NO: 577 - DNA, 20 bp, Homo sapiens
  source 1..20: mol_type = genomic DNA
ctagccacgaatctacccac

SEQ ID NO: 578 - DNA, 20 bp, Homo sapiens
  source 1..20: mol_type = genomic DNA
tagccacgaatctacccacc

SEQ ID NO: 579 - DNA, 20 bp, Homo sapiens
  source 1..20: mol_type = genomic DNA
agccacgaatctacccacca

SEQ ID NO: 580 - DNA, 20 bp, Homo sapiens
  source 1..20: mol_type = genomic DNA
gccacgaatctacccaccaa

SEQ ID NO: 581 - DNA, 20 bp, Homo sapiens
  source 1..20: mol_type = genomic DNA
ccacgaatctacccaccaac

SEQ ID NO: 582 - DNA, 20 bp, Homo sapiens
  source 1..20: mol_type = genomic DNA
cacgaatctacccaccaact

SEQ ID NO: 583 - DNA, 20 bp, Homo sapiens
  source 1..20: mol_type = genomic DNA
acgaatctacccaccaactc

SEQ ID NO: 584 - DNA, 20 bp, Homo sapiens
  source 1..20: mol_type = genomic DNA
cgaatctacccaccaactca

SEQ ID NO: 585 - DNA, 20 bp, Homo sapiens
  source 1..20: mol_type = genomic DNA
gacatacccagacacaaacg

SEQ ID NO: 586 - DNA, 20 bp, Homo sapiens
  source 1..20: mol_type = genomic DNA
acatacccagacacaaacgg

SEQ ID NO: 587 - DNA, 20 bp, Homo sapiens
  source 1..20: mol_type = genomic DNA
catacccagacacaaacggc

SEQ ID NO: 588 - DNA, 20 bp, Homo sapiens
  source 1..20: mol_type = genomic DNA
gccagaaagaggaagagctg

SEQ ID NO: 589 - DNA, 20 bp, Homo sapiens
  source 1..20: mol_type = genomic DNA
ccagaaagaggaagagctgg

SEQ ID NO: 590 - DNA, 20 bp, Homo sapiens
  source 1..20: mol_type = genomic DNA
ggcaggcaggaatggtgagt

SEQ ID NO: 591 - DNA, 20 bp, Homo sapiens
  source 1..20: mol_type = genomic DNA
gcaggcaggaatggtgagtg

SEQ ID NO: 592 - DNA, 20 bp, Homo sapiens
  source 1..20: mol_type = genomic DNA
caggcaggaatggtgagtgg

SEQ ID NO: 593 - DNA, 20 bp, Homo sapiens
  source 1..20: mol_type = genomic DNA
aggcaggaatggtgagtgga

SEQ ID NO: 594 - DNA, 20 bp, Homo sapiens
  source 1..20: mol_type = genomic DNA
ggcaggaatggtgagtggaa

SEQ ID NO: 595 - DNA, 20 bp, Homo sapiens
  source 1..20: mol_type = genomic DNA
gcaggaatggtgagtggaag

SEQ ID NO: 596 - DNA, 20 bp, Homo sapiens
  source 1..20: mol_type = genomic DNA
caggaatggtgagtggaagt

SEQ ID NO: 597 - DNA, 20 bp, Homo sapiens
  source 1..20: mol_type = genomic DNA
aggaatggtgagtggaagtg

SEQ ID NO: 598 - DNA, 20 bp, Homo sapiens
  source 1..20: mol_type = genomic DNA
ggaatggtgagtggaagtgg

SEQ ID NO: 599 - DNA, 20 bp, Homo sapiens
  source 1..20: mol_type = genomic DNA
gaatggtgagtggaagtggc

SEQ ID NO: 600 - DNA, 20 bp, Homo sapiens
  source 1..20: mol_type = genomic DNA
aatggtgagtggaagtggca

SEQ ID NO: 601 - DNA, 20 bp, Homo sapiens
  source 1..20: mol_type = genomic DNA
atggtgagtggaagtggcat

SEQ ID NO: 602 - DNA, 20 bp, Homo sapiens
  source 1..20: mol_type = genomic DNA
tggtgagtggaagtggcatg

SEQ ID NO: 603 - DNA, 20 bp, Homo sapiens
  source 1..20: mol_type = genomic DNA
ggtgagtggaagtggcatgg

SEQ ID NO: 604 - DNA, 12 bp, Homo sapiens
  source 1..12: mol_type = genomic DNA
tcattcatctgt

SEQ ID NO: 605 - DNA, 12 bp, Homo sapiens
  source 1..12: mol_type = genomic DNA
ctcattcatctg

SEQ ID NO: 606 - DNA, 12 bp, Homo sapiens
  source 1..12: mol_type = genomic DNA
actcattcatct

SEQ ID NO: 607 - DNA, 12 bp, Homo sapiens
  source 1..12: mol_type = genomic DNA
cactcattcatc

SEQ ID NO: 608 - DNA, 12 bp, Homo sapiens
  source 1..12: mol_type = genomic DNA
tcactcattcat

SEQ ID NO: 609 - DNA, 12 bp, Homo sapiens
  source 1..12: mol_type = genomic DNA
atcactcattca

SEQ ID NO: 610 - DNA, 12 bp, Homo sapiens
  source 1..12: mol_type = genomic DNA
catcactcattc

SEQ ID NO: 611 - DNA, 12 bp, Homo sapiens
  source 1..12: mol_type = genomic DNA
tcatcactcatt

SEQ ID NO: 612 - DNA, 12 bp, Homo sapiens
  source 1..12: mol_type = genomic DNA
ctcatcactcat

SEQ ID NO: 613 - DNA, 15 bp, Homo sapiens
  source 1..15: mol_type = genomic DNA
cactcattcatctgt

SEQ ID NO: 614 - DNA, 15 bp, Homo sapiens
  source 1..15: mol_type = genomic DNA
tcactcattcatctg

SEQ ID NO: 615 - DNA, 15 bp, Homo sapiens
  source 1..15: mol_type = genomic DNA
atcactcattcatct

SEQ ID NO: 616 - DNA, 15 bp, Homo sapiens
  source 1..15: mol_type = genomic DNA
catcactcattcatc

SEQ ID NO: 617 - DNA, 15 bp, Homo sapiens
  source 1..15: mol_type = genomic DNA
tcatcactcattcat

SEQ ID NO: 618 - DNA, 15 bp, Homo sapiens
  source 1..15: mol_type = genomic DNA
ctcatcactcattca

SEQ ID NO: 619 - DNA, 16 bp, Homo sapiens
  source 1..16: mol_type = genomic DNA
tcactcattcatctgt

SEQ ID NO: 620 - DNA, 16 bp, Homo sapiens
  source 1..16: mol_type = genomic DNA
atcactcattcatctg

SEQ ID NO: 621 - DNA, 16 bp, Homo sapiens
  source 1..16: mol_type = genomic DNA
catcactcattcatct

SEQ ID NO: 622 - DNA, 16 bp, Homo sapiens
  source 1..16: mol_type = genomic DNA
tcatcactcattcatc

SEQ ID NO: 623 - DNA, 16 bp, Homo sapiens
  source 1..16: mol_type = genomic DNA
ctcatcactcattcat

SEQ ID NO: 624 - DNA, 17 bp, Homo sapiens
  source 1..17: mol_type = genomic DNA
atcactcattcatctgt

SEQ ID NO: 625 - DNA, 17 bp, Homo sapiens
  source 1..17: mol_type = genomic DNA
catcactcattcatctg

SEQ ID NO: 626 - DNA, 17 bp, Homo sapiens
  source 1..17: mol_type = genomic DNA
tcatcactcattcatct

SEQ ID NO: 627 - DNA, 17 bp, Homo sapiens
  source 1..17: mol_type = genomic DNA
ctcatcactcattcatc

SEQ ID NO: 628 - DNA, 18 bp, Homo sapiens
  source 1..18: mol_type = genomic DNA
catcactcattcatctgt

SEQ ID NO: 629 - DNA, 18 bp, Homo sapiens
  source 1..18: mol_type = genomic DNA
tcatcactcattcatctg

SEQ ID NO: 630 - DNA, 18 bp, Homo sapiens
  source 1..18: mol_type = genomic DNA
ctcatcactcattcatct

SEQ ID NO: 631 - DNA, 19 bp, Homo sapiens
  source 1..19: mol_type = genomic DNA
tcatcactcattcatctgt

SEQ ID NO: 632 - DNA, 19 bp, Homo sapiens
  source 1..19: mol_type = genomic DNA
ctcatcactcattcatctg

SEQ ID NO: 633 - DNA, 21 bp, Homo sapiens
  source 1..21: mol_type = genomic DNA
ctcatcactcattcatctgtt

SEQ ID NO: 634 - DNA, 21 bp, Homo sapiens
  source 1..21: mol_type = genomic DNA
actcatcactcattcatctgt

SEQ ID NO: 635 - DNA, 22 bp, Homo sapiens
  source 1..22: mol_type = genomic DNA
ctcatcactcattcatctgttc

SEQ ID NO: 636 - DNA, 22 bp, Homo sapiens
  source 1..22: mol_type = genomic DNA
actcatcactcattcatctgtt

SEQ ID NO: 637 - DNA, 22 bp, Homo sapiens
  source 1..22: mol_type = genomic DNA
tactcatcactcattcatctgt

SEQ ID NO: 638 - DNA, 23 bp, Homo sapiens
  source 1..23: mol_type = genomic DNA
ctcatcactcattcatctgttca

SEQ ID NO: 639 - DNA, 23 bp, Homo sapiens
  source 1..23: mol_type = genomic DNA
actcatcactcattcatctgttc

SEQ ID NO: 640 - DNA, 23 bp, Homo sapiens
  source 1..23: mol_type = genomic DNA
tactcatcactcattcatctgtt

SEQ ID NO: 641 - DNA, 23 bp, Homo sapiens
  source 1..23: mol_type = genomic DNA
ctactcatcactcattcatctgt

SEQ ID NO: 642 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gaatctacccaccaactcat

SEQ ID NO: 643 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aatctacccaccaactcatc

SEQ ID NO: 644 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atctacccaccaactcatcc

SEQ ID NO: 645 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tctacccaccaactcatcca

SEQ ID NO: 646 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctacccaccaactcatccat

SEQ ID NO: 647 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tacccaccaactcatccatc

SEQ ID NO: 648 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acccaccaactcatccatct

SEQ ID NO: 649 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
cccaccaactcatccatcta

SEQ ID NO: 650 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccaccaactcatccatctat

SEQ ID NO: 651 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caccaactcatccatctatc

SEQ ID NO: 652 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
accaactcatccatctatcc

SEQ ID NO: 653 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccaactcatccatctatcca

SEQ ID NO: 654 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
caactcatccatctatccat

SEQ ID NO: 655 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aactcatccatctatccatc

SEQ ID NO: 656 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
actcatccatctatccatcc

SEQ ID NO: 657 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ctcatccatctatccatcca

SEQ ID NO: 658 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcatccatctatccatccat

SEQ ID NO: 659 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatctatccatccatg

SEQ ID NO: 660 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
atccatctatccatccatgt

SEQ ID NO: 661 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
tccatctatccatccatgta

SEQ ID NO: 662 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatctatccatccatgtac

SEQ ID NO: 663 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catctatccatccatgtact

SEQ ID NO: 664 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
atctatccatccatgtactc

SEQ ID NO: 665 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tctatccatccatgtactca

SEQ ID NO: 666 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctatccatccatgtactcac

SEQ ID NO: 667 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tatccatccatgtactcacc

SEQ ID NO: 668 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatccatgtactcaccc

SEQ ID NO: 669 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccatgtactcaccca

SEQ ID NO: 670 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccatgtactcacccat

SEQ ID NO: 671 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatgtactcacccatc

SEQ ID NO: 672 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatgtactcacccatct

SEQ ID NO: 673 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatgtactcacccatctc

SEQ ID NO: 674 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ccatgtactcacccatctct

SEQ ID NO: 675 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
catgtactcacccatctctc

SEQ ID NO: 676 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atgtactcacccatctctcc

SEQ ID NO: 677 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tgtactcacccatctctcca

SEQ ID NO: 678 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gtactcacccatctctccat

SEQ ID NO: 679 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tactcacccatctctccatc

SEQ ID NO: 680 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
actcacccatctctccatcc

SEQ ID NO: 681 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ctcacccatctctccatcca

SEQ ID NO: 682 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcacccatctctccatccat

SEQ ID NO: 683 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacccatctctccatccatc

SEQ ID NO: 684 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acccatctctccatccatcc

SEQ ID NO: 685 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccatctctccatccatcct

SEQ ID NO: 686 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ccatctctccatccatcctt

SEQ ID NO: 687 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
catctctccatccatccttt

SEQ ID NO: 688 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atctctccatccatcctttt

SEQ ID NO: 689 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
tctctccatccatcctttta

SEQ ID NO: 690 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ctctccatccatccttttat

SEQ ID NO: 691 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tctccatccatccttttatc

SEQ ID NO: 692 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ctccatccatccttttatct

SEQ ID NO: 693 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccatccttttatctac

SEQ ID NO: 694 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ctactcatcactcattcatc

SEQ ID NO: 695 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
actcatcactcattcatctg

SEQ ID NO: 696 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ctcatcactcattcatctgt

SEQ ID NO: 697 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
catcactcattcatctgttc

SEQ ID NO: 698 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
tcattcattcattcaccagc

SEQ ID NO: 699 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
cattcattcattcaccagca

SEQ ID NO: 700 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ggataagagttctttccagg

SEQ ID NO: 701 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gataagagttctttccagga

SEQ ID NO: 702 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ttccaggaaacccaggcagc

SEQ ID NO: 703 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
tccaggaaacccaggcagct

SEQ ID NO: 704 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
agctggaagagacataccca

SEQ ID NO: 705 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gctggaagagacatacccag

SEQ ID NO: 706 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ctggaagagacatacccaga

SEQ ID NO: 707 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
tggaagagacatacccagac

SEQ ID NO: 708 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ggaagagacatacccagaca

SEQ ID NO: 709 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gaagagacatacccagacac

SEQ ID NO: 710 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
aagagacatacccagacaca

SEQ ID NO: 711 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
agagacatacccagacacaa

SEQ ID NO: 712 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gagacatacccagacacaaa

SEQ ID NO: 713 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
agacatacccagacacaaac

SEQ ID NO: 714 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
gcccaatcctgagtggttag

SEQ ID NO: 715 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
cccaatcctgagtggttagg

SEQ ID NO: 716 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ggctggaatagaaggaagaa

SEQ ID NO: 717 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gctggaatagaaggaagaac

SEQ ID NO: 718 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ctggaatagaaggaagaacc

SEQ ID NO: 719 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tggaatagaaggaagaacct

SEQ ID NO: 720 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ggaatagaaggaagaacctg

SEQ ID NO: 721 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
gaatagaaggaagaacctga

SEQ ID NO: 722 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
atagaaggaagaacctgatg

SEQ ID NO: 723 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
tagaaggaagaacctgatga

SEQ ID NO: 724 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
agaaggaagaacctgatgat

SEQ ID NO: 725 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
gaaggaagaacctgatgatg

SEQ ID NO: 726 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
aaggaagaacctgatgatga

SEQ ID NO: 727 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
aggaagaacctgatgatgag

SEQ ID NO: 728 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ggaagaacctgatgatgagt

SEQ ID NO: 729 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
gaagaacctgatgatgagta

SEQ ID NO: 730 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
aagaacctgatgatgagtag

SEQ ID NO: 731 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
agaacctgatgatgagtagt

SEQ ID NO: 732 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
gaacctgatgatgagtagtg

SEQ ID NO: 733 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
aacctgatgatgagtagtga

SEQ ID NO: 734 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
acctgatgatgagtagtgag

SEQ ID NO: 735 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
cctgatgatgagtagtgaga

SEQ ID NO: 736 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ctgatgatgagtagtgagag

SEQ ID NO: 737 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
tgatgatgagtagtgagagt

SEQ ID NO: 738 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
gatgatgagtagtgagagtc

SEQ ID NO: 739 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atgatgagtagtgagagtca

SEQ ID NO: 740 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tgatgagtagtgagagtcaa

SEQ ID NO: 741 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gatgagtagtgagagtcaac

SEQ ID NO: 742 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
atgagtagtgagagtcaacc

SEQ ID NO: 743 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tgagtagtgagagtcaacct

SEQ ID NO: 744 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
gagtagtgagagtcaacctg

SEQ ID NO: 745 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
agtagtgagagtcaacctgg

SEQ ID NO: 746 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gtagtgagagtcaacctgga

SEQ ID NO: 747 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
tagtgagagtcaacctggag

SEQ ID NO: 748 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
agtgagagtcaacctggagg

SEQ ID NO: 749 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gtgagagtcaacctggaggc

SEQ ID NO: 750 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttcccagaggaggtgaccct

SEQ ID NO: 751 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ccagaggaggtgaccctgaa

SEQ ID NO: 752 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cagaggaggtgaccctgaat

SEQ ID NO: 753 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
agaggaggtgaccctgaatc

SEQ ID NO: 754 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gaggaggtgaccctgaatct

SEQ ID NO: 755 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
aggaggtgaccctgaatctg

SEQ ID NO: 756 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ggaggtgaccctgaatctgg

SEQ ID NO: 757 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gaggtgaccctgaatctgga

SEQ ID NO: 758 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
aggtgaccctgaatctggac

SEQ ID NO: 759 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ggtgaccctgaatctggact

SEQ ID NO: 760 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
gtgaccctgaatctggactt

SEQ ID NO: 761 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
tgaccctgaatctggacttt

SEQ ID NO: 762 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
gaccctgaatctggactttg

SEQ ID NO: 763 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
accctgaatctggactttga

SEQ ID NO: 764 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ccctgaatctggactttgat

SEQ ID NO: 765 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cctgaatctggactttgatg

SEQ ID NO: 766 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ctgaatctggactttgatgg

SEQ ID NO: 767 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
tgaatctggactttgatgga

SEQ ID NO: 768 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
gaatctggactttgatggat

SEQ ID NO: 769 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
atctggactttgatggatag

SEQ ID NO: 770 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
tctggactttgatggatagg

SEQ ID NO: 771 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ggaggagttttccaggtaaa

SEQ ID NO: 772 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gaggagttttccaggtaaag

SEQ ID NO: 773 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
aggagttttccaggtaaagg

SEQ ID NO: 774 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gccaggagagtgtggatggt

SEQ ID NO: 775 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
ccaggagagtgtggatggtg

SEQ ID NO: 776 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
caggagagtgtggatggtgt

SEQ ID NO: 777 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
aggagagtgtggatggtgtg

SEQ ID NO: 778 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ggagagtgtggatggtgtgg

SEQ ID NO: 779 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gagagtgtggatggtgtggc

SEQ ID NO: 780 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
aattacccccaaattcaccc

SEQ ID NO: 781 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
attacccccaaattcaccca

SEQ ID NO: 782 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ttacccccaaattcacccat

SEQ ID NO: 783 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tacccccaaattcacccatc

SEQ ID NO: 784 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acccccaaattcacccatcc

SEQ ID NO: 785 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccccaaattcacccatcca

SEQ ID NO: 786 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccccaaattcacccatccat

SEQ ID NO: 787 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cccaaattcacccatccata

SEQ ID NO: 788 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccaaattcacccatccatac

SEQ ID NO: 789 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
caaattcacccatccataca

SEQ ID NO: 790 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aattcacccatccatacatc

SEQ ID NO: 791 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
attcacccatccatacatct

SEQ ID NO: 792 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ttcacccatccatacatcta

SEQ ID NO: 793 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
tcacccatccatacatctat

SEQ ID NO: 794 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacccatccatacatctata

SEQ ID NO: 795 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
acccatccatacatctatac

SEQ ID NO: 796 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cccatccatacatctatact

SEQ ID NO: 797 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
catatatccatccatctgtc

SEQ ID NO: 798 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atatatccatccatctgtcc

SEQ ID NO: 799 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tatatccatccatctgtcca

SEQ ID NO: 800 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
atatccatccatctgtccat

SEQ ID NO: 801 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tatccatccatctgtccatc

SEQ ID NO: 802 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccatctgtccatcc

SEQ ID NO: 803 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccatctgtccatcca

SEQ ID NO: 804 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccatctgtccatccat

SEQ ID NO: 805 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatctgtccatccatc

SEQ ID NO: 806 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatctgtccatccatcc

SEQ ID NO: 807 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatctgtccatccatcca

SEQ ID NO: 808 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatctgtccatccatccat

SEQ ID NO: 809 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catctgtccatccatccatc

SEQ ID NO: 810 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atctgtccatccatccatca

SEQ ID NO: 811 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tctgtccatccatccatcat

SEQ ID NO: 812 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ctgtccatccatccatcatc

SEQ ID NO: 813 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tgtccatccatccatcatcc

SEQ ID NO: 814 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
gtccatccatccatcatcca

SEQ ID NO: 815 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tccatccatccatcatccat

SEQ ID NO: 816 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ccatccatccatcatccatc

SEQ ID NO: 817 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
catccatccatcatccatct

SEQ ID NO: 818 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
atccatccatcatccatcta

SEQ ID NO: 819 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
tccatccatcatccatctag

SEQ ID NO: 820 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ccatccatcatccatctagc

SEQ ID NO: 821 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
catccatcatccatctagcc

SEQ ID NO: 822 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatcatccatctagcca

SEQ ID NO: 823 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tccatcatccatctagccac

SEQ ID NO: 824 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ggagagaaagtgtcatggag

SEQ ID NO: 825 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
gagagaaagtgtcatggaga

SEQ ID NO: 826 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
agagaaagtgtcatggagag

SEQ ID NO: 827 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
gagaaagtgtcatggagagt

SEQ ID NO: 828 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
agaaagtgtcatggagagtg

SEQ ID NO: 829 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
gaaagtgtcatggagagtgc

SEQ ID NO: 830 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ggcagcttacatcatccatc

SEQ ID NO: 831 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gcagcttacatcatccatct

SEQ ID NO: 832 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
cagcttacatcatccatctg

SEQ ID NO: 833 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
agcttacatcatccatctgc

SEQ ID NO: 834 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
gcttacatcatccatctgcc

SEQ ID NO: 835 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cttacatcatccatctgcct

SEQ ID NO: 836 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ttacatcatccatctgcctg

SEQ ID NO: 837 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
tacatcatccatctgcctgt

SEQ ID NO: 838 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
acatcatccatctgcctgtt

SEQ ID NO: 839 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
catcatccatctgcctgttt

SEQ ID NO: 840 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atcatccatctgcctgttta

SEQ ID NO: 841 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
tcatccatctgcctgtttat

SEQ ID NO: 842 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatctgcctgtttatt

SEQ ID NO: 843 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atccatctgcctgtttattc

SEQ ID NO: 844 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tccatctgcctgtttattca

SEQ ID NO: 845 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatctgcctgtttattcat

SEQ ID NO: 846 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctactcttttatccatccac

SEQ ID NO: 847 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
actcttttatccatccacac

SEQ ID NO: 848 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ctcttttatccatccacaca

SEQ ID NO: 849 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcttttatccatccacacac

SEQ ID NO: 850 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cttttatccatccacacacc

SEQ ID NO: 851 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttttatccatccacacaccc

SEQ ID NO: 852 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tttatccatccacacaccca

SEQ ID NO: 853 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ttatccatccacacacccac

SEQ ID NO: 854 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tatccatccacacacccacc

SEQ ID NO: 855 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatccacacacccaccc

SEQ ID NO: 856 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccacacacccaccca

SEQ ID NO: 857 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccacacacccacccat

SEQ ID NO: 858 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccacacacccacccatc

SEQ ID NO: 859 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccacacacccacccatct

SEQ ID NO: 860 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccacacacccacccatcta

SEQ ID NO: 861 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccacacacccacccatctaa

SEQ ID NO: 862 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cacacacccacccatctaac

SEQ ID NO: 863 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
acacacccacccatctaact

SEQ ID NO: 864 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
cacacccacccatctaacta

SEQ ID NO: 865 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
acacccacccatctaactac

SEQ ID NO: 866 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cacccacccatctaactacc

SEQ ID NO: 867 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
acccacccatctaactaccc

SEQ ID NO: 868 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccacccatctaactacccc

SEQ ID NO: 869 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccacccatctaactacccca

SEQ ID NO: 870 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
cacccatctaactaccccaa

SEQ ID NO: 871 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
acccatctaactaccccaaa

SEQ ID NO: 872 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cccatctaactaccccaaat

SEQ ID NO: 873 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ccatctaactaccccaaatt

SEQ ID NO: 874 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
aatttcacccatccactctt

SEQ ID NO: 875 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atttcacccatccactcttc

SEQ ID NO: 876 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tttcacccatccactcttcc

SEQ ID NO: 877 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttcacccatccactcttcca

SEQ ID NO: 878 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcacccatccactcttccaa

SEQ ID NO: 879 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cacccatccactcttccaac

SEQ ID NO: 880 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
acccatccactcttccaacc

SEQ ID NO: 881 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccatccactcttccaacct

SEQ ID NO: 882 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ccatccactcttccaacctt

SEQ ID NO: 883 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
catccactcttccaaccttt

SEQ ID NO: 884 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atccactcttccaacctttc

SEQ ID NO: 885 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tccactcttccaacctttca

SEQ ID NO: 886 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccactcttccaacctttcag

SEQ ID NO: 887 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
cactcttccaacctttcagt

SEQ ID NO: 888 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
actcttccaacctttcagta

SEQ ID NO: 889 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ctcttccaacctttcagtaa

SEQ ID NO: 890 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
cctttcagtaattcaaccac

SEQ ID NO: 891 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cagtaattcaaccacacatc

SEQ ID NO: 892 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
agtaattcaaccacacatcc

SEQ ID NO: 893 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
gtaattcaaccacacatcca

SEQ ID NO: 894 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aattcaaccacacatccatc

SEQ ID NO: 895 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
attcaaccacacatccatcc

SEQ ID NO: 896 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttcaaccacacatccatcca

SEQ ID NO: 897 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcaaccacacatccatccat

SEQ ID NO: 898 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caaccacacatccatccatc

SEQ ID NO: 899 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
aaccacacatccatccatcc

SEQ ID NO: 900 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
accacacatccatccatcca

SEQ ID NO: 901 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccacacatccatccatccat

SEQ ID NO: 902 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacacatccatccatccatc

SEQ ID NO: 903 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acacatccatccatccatcc

SEQ ID NO: 904 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cacatccatccatccatcca

SEQ ID NO: 905 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acatccatccatccatccat

SEQ ID NO: 906 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccatccatccatt

SEQ ID NO: 907 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atccatccatccatccattc

SEQ ID NO: 908 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tccatccatccatccattca

SEQ ID NO: 909 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccatccatccattcat

SEQ ID NO: 910 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccatccattcatc

SEQ ID NO: 911 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccatccattcatcc

SEQ ID NO: 912 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccatccattcatcca

SEQ ID NO: 913 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccatccattcatccat

SEQ ID NO: 914 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccattcatccatc

SEQ ID NO: 915 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccattcatccatcc

SEQ ID NO: 916 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccattcatccatccc

SEQ ID NO: 917 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccatccattcatccatccca

SEQ ID NO: 918 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
catccattcatccatcccat

SEQ ID NO: 919 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
atccattcatccatcccata

SEQ ID NO: 920 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
tccattcatccatcccatac

SEQ ID NO: 921 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ccattcatccatcccataca

SEQ ID NO: 922 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
cattcatccatcccatacat

SEQ ID NO: 923 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
ttcatccatcccatacattg

SEQ ID NO: 924 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
tcatccatcccatacattga

SEQ ID NO: 925 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
catccatcccatacattgat

SEQ ID NO: 926 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
atccatcccatacattgatc

SEQ ID NO: 927 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tccatcccatacattgatcc

SEQ ID NO: 928 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
gcaacttaatccacctaccc

SEQ ID NO: 929 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
caacttaatccacctaccca

SEQ ID NO: 930 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
aacttaatccacctacccaa

SEQ ID NO: 931 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
acttaatccacctacccaat

SEQ ID NO: 932 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cttaatccacctacccaatc

SEQ ID NO: 933 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ttaatccacctacccaatca

SEQ ID NO: 934 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
taatccacctacccaatcat

SEQ ID NO: 935 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aatccacctacccaatcatt

SEQ ID NO: 936 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atccacctacccaatcattc

SEQ ID NO: 937 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tccacctacccaatcattca

SEQ ID NO: 938 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccacctacccaatcattcat

SEQ ID NO: 939 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacctacccaatcattcatt

SEQ ID NO: 940 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
acctacccaatcattcattc

SEQ ID NO: 941 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
cctacccaatcattcattct

SEQ ID NO: 942 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
ctttcatacaaccaaccatc

SEQ ID NO: 943 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tttcatacaaccaaccatcc

SEQ ID NO: 944 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttcatacaaccaaccatcca

SEQ ID NO: 945 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcatacaaccaaccatccat

SEQ ID NO: 946 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catacaaccaaccatccatc

SEQ ID NO: 947 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atacaaccaaccatccatcc

SEQ ID NO: 948 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tacaaccaaccatccatcca

SEQ ID NO: 949 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acaaccaaccatccatccac

SEQ ID NO: 950 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
caaccaaccatccatccacc

SEQ ID NO: 951 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
aaccaaccatccatccaccc

SEQ ID NO: 952 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
accaaccatccatccaccca

SEQ ID NO: 953 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccaaccatccatccacccat

SEQ ID NO: 954 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caaccatccatccacccatc

SEQ ID NO: 955 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
aaccatccatccacccatca

SEQ ID NO: 956 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
accatccatccacccatcaa

SEQ ID NO: 957 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ccatccatccacccatcaat

SEQ ID NO: 958 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccacccatcaatt

SEQ ID NO: 959 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atccatccacccatcaattt

SEQ ID NO: 960 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
tccatccacccatcaattta

SEQ ID NO: 961 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccacccatcaatttat

SEQ ID NO: 962 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccacccatcaatttatc

SEQ ID NO: 963 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccacccatcaatttatcc

SEQ ID NO: 964 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccacccatcaatttatcca

SEQ ID NO: 965 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccacccatcaatttatccaa

SEQ ID NO: 966 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cacccatcaatttatccaac

SEQ ID NO: 967 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
acccatcaatttatccaacc

SEQ ID NO: 968 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccatcaatttatccaacca

SEQ ID NO: 969 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccaaccatccatttttcg

SEQ ID NO: 970 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose guanosine phosphorothioate
tccaaccatccatttttcgt

SEQ ID NO: 971 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
ccaaccatccatttttcgtc

SEQ ID NO: 972 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
caaccatccatttttcgtct

SEQ ID NO: 973 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
aaccatccatttttcgtctg

SEQ ID NO: 974 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
accatccatttttcgtctgt

SEQ ID NO: 975 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
ccatccatttttcgtctgtc

SEQ ID NO: 976 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
catccatttttcgtctgtcc

SEQ ID NO: 977 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatttttcgtctgtcca

SEQ ID NO: 978 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tccatttttcgtctgtccac

SEQ ID NO: 979 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ccatttttcgtctgtccacc

SEQ ID NO: 980 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
catttttcgtctgtccacca

SEQ ID NO: 981 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
atttttcgtctgtccaccag

SEQ ID NO: 982 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
tttttcgtctgtccaccagc

SEQ ID NO: 983 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
ttttcgtctgtccaccagcc

SEQ ID NO: 984 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tttcgtctgtccaccagcca

SEQ ID NO: 985 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ttcgtctgtccaccagccac

SEQ ID NO: 986 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tcgtctgtccaccagccact

SEQ ID NO: 987 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gtctgtccaccagccactca

SEQ ID NO: 988 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tctgtccaccagccactcac

SEQ ID NO: 989 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ctgtccaccagccactcaca

SEQ ID NO: 990 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tgtccaccagccactcacaa

SEQ ID NO: 991 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gtccaccagccactcacaac

SEQ ID NO: 992 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tccaccagccactcacaacc

SEQ ID NO: 993 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccaccagccactcacaacca

SEQ ID NO: 994 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
caccagccactcacaaccat

SEQ ID NO: 995 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
accagccactcacaaccatc

SEQ ID NO: 996 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ccagccactcacaaccatcc

SEQ ID NO: 997 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cagccactcacaaccatcca

SEQ ID NO: 998 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
agccactcacaaccatccat

SEQ ID NO: 999 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
gccactcacaaccatccatc

SEQ ID NO: 1000 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ccactcacaaccatccatct

SEQ ID NO: 1001 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
cactcacaaccatccatcta

SEQ ID NO: 1002 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
actcacaaccatccatctaa

SEQ ID NO: 1003 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ctcacaaccatccatctaaa

SEQ ID NO: 1004 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gcaatagttcaaccacacat

SEQ ID NO: 1005 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caatagttcaaccacacatc

SEQ ID NO: 1006 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
aatagttcaaccacacatcc

SEQ ID NO: 1007 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atagttcaaccacacatcct

SEQ ID NO: 1008 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tagttcaaccacacatcctt

SEQ ID NO: 1009 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
agttcaaccacacatccttc

SEQ ID NO: 1010 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gttcaaccacacatccttcc

SEQ ID NO: 1011 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttcaaccacacatccttcca

SEQ ID NO: 1012 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcaaccacacatccttccat

SEQ ID NO: 1013 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caaccacacatccttccatt

SEQ ID NO: 1014 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
aaccacacatccttccattc

SEQ ID NO: 1015 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
accacacatccttccattca

SEQ ID NO: 1016 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccacacatccttccattcat

SEQ ID NO: 1017 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacacatccttccattcatc

SEQ ID NO: 1018 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acacatccttccattcatcc

SEQ ID NO: 1019 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cacatccttccattcatcca

SEQ ID NO: 1020 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acatccttccattcatccac

SEQ ID NO: 1021 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catccttccattcatccacc

SEQ ID NO: 1022 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccttccattcatccaccc

SEQ ID NO: 1023 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccttccattcatccaccca

SEQ ID NO: 1024 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccttccattcatccacccac

SEQ ID NO: 1025 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cttccattcatccacccacc

SEQ ID NO: 1026 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttccattcatccacccaccc

SEQ ID NO: 1027 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccattcatccacccaccca

SEQ ID NO: 1028 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cattcatccacccacccatt

SEQ ID NO: 1029 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
attcatccacccacccattc

SEQ ID NO: 1030 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ttcatccacccacccattca

SEQ ID NO: 1031 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcatccacccacccattcat

SEQ ID NO: 1032 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccacccacccattcatc

SEQ ID NO: 1033 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccacccacccattcatcc

SEQ ID NO: 1034 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccacccacccattcatcca

SEQ ID NO: 1035 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccacccacccattcatccat

SEQ ID NO: 1036 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacccacccattcatccatt

SEQ ID NO: 1037 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
acccacccattcatccattt

SEQ ID NO: 1038 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
cccacccattcatccatttg

SEQ ID NO: 1039 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ccacccattcatccatttgt

SEQ ID NO: 1040 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
cacccattcatccatttgtc

SEQ ID NO: 1041 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acccattcatccatttgtcc

SEQ ID NO: 1042 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccattcatccatttgtccat

SEQ ID NO: 1043 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cattcatccatttgtccatc

SEQ ID NO: 1044 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
ttcatccatttgtccatctg

SEQ ID NO: 1045 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
tcatccatttgtccatctgc

SEQ ID NO: 1046 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
catccatttgtccatctgcc

SEQ ID NO: 1047 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatttgtccatctgcct

SEQ ID NO: 1048 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatttgtccatctgccta

SEQ ID NO: 1049 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatttgtccatctgcctat

SEQ ID NO: 1050 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catttgtccatctgcctata

SEQ ID NO: 1051 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
atttgtccatctgcctatac

SEQ ID NO: 1052 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tttgtccatctgcctataca

SEQ ID NO: 1053 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ttgtccatctgcctatacat

SEQ ID NO: 1054 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tgtccatctgcctatacatc

SEQ ID NO: 1055 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gtccatctgcctatacatcc

SEQ ID NO: 1056 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatctgcctatacatcca

SEQ ID NO: 1057 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatctgcctatacatccat

SEQ ID NO: 1058 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catctgcctatacatccatc

SEQ ID NO: 1059 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atctgcctatacatccatcc

SEQ ID NO: 1060 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tctgcctatacatccatcca

SEQ ID NO: 1061 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctgcctatacatccatccat

SEQ ID NO: 1062 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tgcctatacatccatccatc

SEQ ID NO: 1063 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gcctatacatccatccatcc

SEQ ID NO: 1064 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cctatacatccatccatcca

SEQ ID NO: 1065 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctatacatccatccatccat

SEQ ID NO: 1066 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tatacatccatccatccatc

SEQ ID NO: 1067 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atacatccatccatccatcc

SEQ ID NO: 1068 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tacatccatccatccatcca

SEQ ID NO: 1069 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acatccatccatccatccat

SEQ ID NO: 1070 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccatccatccatc

SEQ ID NO: 1071 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccatccatccatcc

SEQ ID NO: 1072 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatccatccatccatcca

SEQ ID NO: 1073 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatccatccatccatccat

SEQ ID NO: 1074 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccatccatccatc

SEQ ID NO: 1075 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccatccatccatct

SEQ ID NO: 1076 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatccatccatccatcta

SEQ ID NO: 1077 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccatccatccatctac

SEQ ID NO: 1078 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catccatccatccatctacc

SEQ ID NO: 1079 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatccatccatctacct

SEQ ID NO: 1080 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatccatccatctaccta

SEQ ID NO: 1081 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccatccatctacctat

SEQ ID NO: 1082 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatccatctacctatc

SEQ ID NO: 1083 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatccatctacctatct

SEQ ID NO: 1084 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatccatctacctatcta

SEQ ID NO: 1085 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccatctacctatctac

SEQ ID NO: 1086 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catccatctacctatctacc

SEQ ID NO: 1087 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccatctacctatctaccc

SEQ ID NO: 1088 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccatctacctatctaccca

SEQ ID NO: 1089 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccatctacctatctacccat

SEQ ID NO: 1090 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catctacctatctacccatc

SEQ ID NO: 1091 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atctacctatctacccatct

SEQ ID NO: 1092 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tctacctatctacccatctg

SEQ ID NO: 1093 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ctacctatctacccatctga

SEQ ID NO: 1094 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
tacctatctacccatctgac

SEQ ID NO: 1095 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
acctatctacccatctgact

SEQ ID NO: 1096 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
cctatctacccatctgacta

SEQ ID NO: 1097 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ctatctacccatctgactat

SEQ ID NO: 1098 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tatctacccatctgactatc

SEQ ID NO: 1099 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atctacccatctgactatca

SEQ ID NO: 1100 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tctacccatctgactatcaa

SEQ ID NO: 1101 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ctacccatctgactatcaac

SEQ ID NO: 1102 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tacccatctgactatcaaca

SEQ ID NO: 1103 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acccatctgactatcaacaa

SEQ ID NO: 1104 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cccatctgactatcaacaaa

SEQ ID NO: 1105 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
cacctatctactcaatcttc

SEQ ID NO: 1106 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acctatctactcaatcttcc

SEQ ID NO: 1107 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cctatctactcaatcttcct

SEQ ID NO: 1108 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccttctaataactcaaccac

SEQ ID NO: 1109 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
aataactcaaccacacttcc

SEQ ID NO: 1110 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ataactcaaccacacttcca

SEQ ID NO: 1111 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
taactcaaccacacttccat

SEQ ID NO: 1112 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
aactcaaccacacttccatc

SEQ ID NO: 1113 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
actcaaccacacttccatcc

SEQ ID NO: 1114 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ctcaaccacacttccatcca

SEQ ID NO: 1115 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcaaccacacttccatccat

SEQ ID NO: 1116 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caaccacacttccatccatc

SEQ ID NO: 1117 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
aaccacacttccatccatcc

SEQ ID NO: 1118 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
accacacttccatccatccc

SEQ ID NO: 1119 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccacacttccatccatccca

SEQ ID NO: 1120 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
cacacttccatccatcccat

SEQ ID NO: 1121 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
acacttccatccatcccatc

SEQ ID NO: 1122 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
cacttccatccatcccatcc

SEQ ID NO: 1123 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
acttccatccatcccatcca

SEQ ID NO: 1124 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
cttccatccatcccatccaa

SEQ ID NO: 1125 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ttccatccatcccatccaat

SEQ ID NO: 1126 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tccatccatcccatccaata

SEQ ID NO: 1127 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatccatcccatccaatac

SEQ ID NO: 1128 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catccatcccatccaataca

SEQ ID NO: 1129 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
atccatcccatccaatacaa

SEQ ID NO: 1130 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
tccatcccatccaatacaac

SEQ ID NO: 1131 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ccatcccatccaatacaact

SEQ ID NO: 1132 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
catcccatccaatacaactt

SEQ ID NO: 1133 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acaacttaatctgctcatcc

SEQ ID NO: 1134 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
caacttaatctgctcatcca

SEQ ID NO: 1135 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
acttaatctgctcatccaac

SEQ ID NO: 1136 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cttaatctgctcatccaaca

SEQ ID NO: 1137 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose thymidine phosphorothioate
atctgctcatccaacatttc

SEQ ID NO: 1138 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tctgctcatccaacatttca

SEQ ID NO: 1139 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctgctcatccaacatttcat

SEQ ID NO: 1140 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tgctcatccaacatttcatc

SEQ ID NO: 1141 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gctcatccaacatttcatct

SEQ ID NO: 1142 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccaacatttcatctatccac

SEQ ID NO: 1143 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
caacatttcatctatccacc

SEQ ID NO: 1144 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
aacatttcatctatccaccc

SEQ ID NO: 1145 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
acatttcatctatccaccca

SEQ ID NO: 1146 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
catttcatctatccacccag

SEQ ID NO: 1147 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
atttcatctatccacccagt

SEQ ID NO: 1148 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
tttcatctatccacccagtc

SEQ ID NO: 1149 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
ttcatctatccacccagtca

SEQ ID NO: 1150 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcatctatccacccagtcaa

SEQ ID NO: 1151 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
catctatccacccagtcaat

SEQ ID NO: 1152 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
atctatccacccagtcaatc

SEQ ID NO: 1153 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
tctatccacccagtcaatca

SEQ ID NO: 1154 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctatccacccagtcaatcat

SEQ ID NO: 1155 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tatccacccagtcaatcatc

SEQ ID NO: 1156 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccacccagtcaatcatct

SEQ ID NO: 1157 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccacccagtcaatcatcta

SEQ ID NO: 1158 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccacccagtcaatcatctat

SEQ ID NO: 1159 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cacccagtcaatcatctatc

SEQ ID NO: 1160 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
acccagtcaatcatctatcc

SEQ ID NO: 1161 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccagtcaatcatctatcca

SEQ ID NO: 1162 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccagtcaatcatctatccag

SEQ ID NO: 1163 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
cagtcaatcatctatccagc

SEQ ID NO: 1164 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
agtcaatcatctatccagca

SEQ ID NO: 1165 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gtcaatcatctatccagcaa

SEQ ID NO: 1166 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
caatcatctatccagcaatc

SEQ ID NO: 1167 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catctatccagcaatctatc

SEQ ID NO: 1168 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccagcaatctatctatcc

SEQ ID NO: 1169 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccagcaatctatctatcca

SEQ ID NO: 1170 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccagcaatctatctatccac

SEQ ID NO: 1171 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cagcaatctatctatccact

SEQ ID NO: 1172 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
agcaatctatctatccactc

SEQ ID NO: 1173 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
gcaatctatctatccactca

SEQ ID NO: 1174 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ctatctatccactcatcaag

SEQ ID NO: 1175 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccactcatcaagttatcc

SEQ ID NO: 1176 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tccactcatcaagttatcca

SEQ ID NO: 1177 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccactcatcaagttatccat

SEQ ID NO: 1178 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cactcatcaagttatccatc

SEQ ID NO: 1179 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
actcatcaagttatccatcc

SEQ ID NO: 1180 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ctcatcaagttatccatcca

SEQ ID NO: 1181 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catcaagttatccatccatc

SEQ ID NO: 1182 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccatcatctaacaattaccc

SEQ ID NO: 1183 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
catcatctaacaattacccc

SEQ ID NO: 1184 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atcatctaacaattaccccc

SEQ ID NO: 1185 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tcatctaacaattaccccca

SEQ ID NO: 1186 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
catctaacaattacccccaa

SEQ ID NO: 1187 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
acaattacccccaaattcac

SEQ ID NO: 1188 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
caattacccccaaattcacc

SEQ ID NO: 1189 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ccatcccatacattgatccg

SEQ ID NO: 1190 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose guanosine phosphorothioate
catcccatacattgatccgc

SEQ ID NO: 1191 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
atcccatacattgatccgca

SEQ ID NO: 1192 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tcccatacattgatccgcaa

SEQ ID NO: 1193 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
cccatacattgatccgcaac

SEQ ID NO: 1194 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ccatacattgatccgcaact

SEQ ID NO: 1195 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose guanosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
catacattgatccgcaactt

SEQ ID NO: 1196 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
cattgatccgcaacttaatc

SEQ ID NO: 1197 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
attgatccgcaacttaatcc

SEQ ID NO: 1198 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose guanosine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
ttgatccgcaacttaatcca

SEQ ID NO: 1199 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose guanosine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
tgatccgcaacttaatccac

SEQ ID NO: 1200 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
gatccgcaacttaatccacc

SEQ ID NO: 1201 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atccgcaacttaatccacct

SEQ ID NO: 1202 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccgcaacttaatccaccta

SEQ ID NO: 1203 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccgcaacttaatccacctac

SEQ ID NO: 1204 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cgcaacttaatccacctacc

SEQ ID NO: 1205 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ccattcatccacccacccat

SEQ ID NO: 1206 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
cccattcatccatttgtcca

SEQ ID NO: 1207 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
ccatcatccatctagccacg

SEQ ID NO: 1208 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose guanosine phosphorothioate
catcatccatctagccacga

SEQ ID NO: 1209 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
atcatccatctagccacgaa

SEQ ID NO: 1210 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
tcatccatctagccacgaat

SEQ ID NO: 1211 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
catccatctagccacgaatc

SEQ ID NO: 1212 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
atccatctagccacgaatct

SEQ ID NO: 1213 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
tccatctagccacgaatcta

SEQ ID NO: 1214 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose adenosine phosphorothioate
ccatctagccacgaatctac

SEQ ID NO: 1215 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
catctagccacgaatctacc

SEQ ID NO: 1216 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
atctagccacgaatctaccc

SEQ ID NO: 1217 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
tctagccacgaatctaccca

SEQ ID NO: 1218 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
ctagccacgaatctacccac

SEQ ID NO: 1219 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
tagccacgaatctacccacc

SEQ ID NO: 1220 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose cytidine phosphorothioate
agccacgaatctacccacca

SEQ ID NO: 1221 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
gccacgaatctacccaccaa

SEQ ID NO: 1222 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose cytidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
ccacgaatctacccaccaac

SEQ ID NO: 1223 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
cacgaatctacccaccaact

SEQ ID NO: 1224 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
acgaatctacccaccaactc

SEQ ID NO: 1225 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose cytidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
cgaatctacccaccaactca

SEQ ID NO: 1226 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose cytidine phosphorothioate
gacatacccagacacaaacg

SEQ ID NO: 1227 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose cytidine phosphorothioate
  modified_base 19: mod_base = OTHER; note = 2'-methoxyethylribose guanosine phosphorothioate
acatacccagacacaaacgg

SEQ ID NO: 1228 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose cytidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose cytidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
catacccagacacaaacggc

SEQ ID NO: 1229 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
gccagaaagaggaagagctg

SEQ ID NO: 1230 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ccagaaagaggaagagctgg

SEQ ID NO: 1231 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
ggcaggcaggaatggtgagt

SEQ ID NO: 1232 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
gcaggcaggaatggtgagtg

SEQ ID NO: 1233 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
caggcaggaatggtgagtgg

SEQ ID NO: 1234 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
aggcaggaatggtgagtgga

SEQ ID NO: 1235 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose adenosine phosphorothioate
ggcaggaatggtgagtggaa

SEQ ID NO: 1236 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose adenosine phosphorothioate
  modified_base 19: mod_base = OTHER; note = 2'-methoxyethylribose adenosine phosphorothioate
gcaggaatggtgagtggaag

SEQ ID NO: 1237 - DNA, 20 bp, synthetic construct
  source 1..20: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose adenosine phosphorothioate
  modified_base 18: mod_base = OTHER; note = 2'-methoxyethylribose adenosine phosphorothioate
  modified_base 19: mod_base = OTHER; note = 2'-methoxyethylribose guanosine phosphorothioate
caggaatggtgagtggaagt

SEQ ID NO: 1238 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose adenosine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose adenosine phosphorothioate
  modified_base 17: mod_base = OTHER; note = 2'-methoxyethylribose adenosine phosphorothioate
  modified_base 18: mod_base = OTHER; note = 2'-methoxyethylribose guanosine phosphorothioate
  modified_base 19: mod_base = OTHER; note = 2'-methoxyethylribose thymidine phosphorothioate
aggaatggtgagtggaagtg

SEQ ID NO: 1239 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose adenosine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose guanosine phosphorothioate
  modified_base 12: mod_base = OTHER; note = 2'-methoxyethylribose thymidine phosphorothioate
  modified_base 13: mod_base = OTHER; note = 2'-methoxyethylribose guanosine phosphorothioate
  modified_base 14: mod_base = OTHER; note = 2'-methoxyethylribose guanosine phosphorothioate
  modified_base 15: mod_base = OTHER; note = 2'-methoxyethylribose adenosine phosphorothioate
  modified_base 16: mod_base = OTHER; note = 2'-methoxyethylribose adenosine phosphorothioate
  modified_base 17: mod_base = OTHER; note = 2'-methoxyethylribose guanosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ggaatggtgagtggaagtgg

SEQ ID NO: 1240 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose adenosine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose adenosine phosphorothioate
  modified_base 10: mod_base = OTHER; note = 2'-methoxyethylribose guanosine phosphorothioate
  modified_base 11: mod_base = OTHER; note = 2'-methoxyethylribose thymidine phosphorothioate
  modified_base 12: mod_base = OTHER; note = 2'-methoxyethylribose guanosine phosphorothioate
  modified_base 13: mod_base = OTHER; note = 2'-methoxyethylribose guanosine phosphorothioate
  modified_base 14: mod_base = OTHER; note = 2'-methoxyethylribose adenosine phosphorothioate
  modified_base 15: mod_base = OTHER; note = 2'-methoxyethylribose adenosine phosphorothioate
  modified_base 16: mod_base = OTHER; note = 2'-methoxyethylribose guanosine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
  modified_base 19: mod_base = OTHER; note = 2'-methoxyethylribose guanosine phosphorothioate
gaatggtgagtggaagtggc

SEQ ID NO: 1241 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose guanosine phosphorothioate
  modified_base 6: mod_base = OTHER; note = 2'-methoxyethylribose thymidine phosphorothioate
  modified_base 7: mod_base = OTHER; note = 2'-methoxyethylribose guanosine phosphorothioate
  modified_base 8: mod_base = OTHER; note = 2'-methoxyethylribose adenosine phosphorothioate
  modified_base 9: mod_base = OTHER; note = 2'-methoxyethylribose guanosine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
  modified_base 12: mod_base = OTHER; note = 2'-methoxyethylribose guanosine phosphorothioate
  modified_base 13: mod_base = OTHER; note = 2'-methoxyethylribose adenosine phosphorothioate
  modified_base 14: mod_base = OTHER; note = 2'-methoxyethylribose adenosine phosphorothioate
  modified_base 15: mod_base = OTHER; note = 2'-methoxyethylribose guanosine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
  modified_base 18: mod_base = OTHER; note = 2'-methoxyethylribose guanosine phosphorothioate
  modified_base 19: mod_base = OTHER; note = 2'-methoxyethylribose cytidine phosphorothioate
aatggtgagtggaagtggca

SEQ ID NO: 1242 - DNA, 20 bp, synthetic construct
  source 1..20: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose guanosine phosphorothioate
  modified_base 4: mod_base = OTHER; note = 2'-methoxyethylribose guanosine phosphorothioate
  modified_base 5: mod_base = OTHER; note = 2'-methoxyethylribose thymidine phosphorothioate
  modified_base 6: mod_base = OTHER; note = 2'-methoxyethylribose guanosine phosphorothioate
  modified_base 7: mod_base = OTHER; note = 2'-methoxyethylribose adenosine phosphorothioate
  modified_base 8: mod_base = OTHER; note = 2'-methoxyethylribose guanosine phosphorothioate
  modified_base 9: mod_base = OTHER; note = 2'-methoxyethylribose thymidine phosphorothioate
  modified_base 10: mod_base = OTHER; note = 2'-methoxyethylribose guanosine phosphorothioate
  modified_base 11: mod_base = OTHER; note = 2'-methoxyethylribose guanosine phosphorothioate
  modified_base 12: mod_base = OTHER; note = 2'-methoxyethylribose adenosine phosphorothioate
  modified_base 13: mod_base = OTHER; note = 2'-methoxyethylribose adenosine phosphorothioate
  modified_base 14: mod_base = OTHER; note = 2'-methoxyethylribose guanosine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
  modified_base 17: mod_base = OTHER; note = 2'-methoxyethylribose guanosine phosphorothioate
  modified_base 18: mod_base = OTHER; note = 2'-methoxyethylribose cytidine phosphorothioate
  modified_base 19: mod_base = OTHER; note = 2'-methoxyethylribose adenosine phosphorothioate
atggtgagtggaagtggcat

SEQ ID NO: 1243 - DNA, 20 bp, synthetic construct
  source 1..20: mol_type = other DNA
  modified_base 1: mod_base = OTHER; note = 2'-methoxyethylribose thymidine phosphorothioate
  modified_base 2: mod_base = OTHER; note = 2'-methoxyethylribose guanosine phosphorothioate
  modified_base 3: mod_base = OTHER; note = 2'-methoxyethylribose guanosine phosphorothioate
  modified_base 4: mod_base = OTHER; note = 2'-methoxyethylribose thymidine phosphorothioate
  modified_base 5: mod_base = OTHER; note = 2'-methoxyethylribose guanosine phosphorothioate
  modified_base 6: mod_base = OTHER; note = 2'-methoxyethylribose adenosine phosphorothioate
  modified_base 7: mod_base = OTHER; note = 2'-methoxyethylribose guanosine phosphorothioate
  modified_base 8: mod_base = OTHER; note = 2'-methoxyethylribose thymidine phosphorothioate
  modified_base 9: mod_base = OTHER; note = 2'-methoxyethylribose guanosine phosphorothioate
  modified_base 10: mod_base = OTHER; note = 2'-methoxyethylribose guanosine phosphorothioate
  modified_base 11: mod_base = OTHER; note = 2'-methoxyethylribose adenosine phosphorothioate
  modified_base 12: mod_base = OTHER; note = 2'-methoxyethylribose adenosine phosphorothioate
  modified_base 13: mod_base = OTHER; note = 2'-methoxyethylribose guanosine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
  modified_base 16: mod_base = OTHER; note = 2'-methoxyethylribose guanosine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
tggtgagtggaagtggcatg

SEQ ID NO: 1244 - DNA, 20 bp, synthetic construct
  source 1..20: mol_type = other DNA
  modified_base 1: mod_base = OTHER; note = 2'-methoxyethylribose guanosine phosphorothioate
  modified_base 2: mod_base = OTHER; note = 2'-methoxyethylribose guanosine phosphorothioate
  modified_base 3: mod_base = OTHER; note = 2'-methoxyethylribose thymidine phosphorothioate
  modified_base 4: mod_base = OTHER; note = 2'-methoxyethylribose guanosine phosphorothioate
  modified_base 5: mod_base = OTHER; note = 2'-methoxyethylribose adenosine phosphorothioate
  modified_base 6: mod_base = OTHER; note = 2'-methoxyethylribose guanosine phosphorothioate
  modified_base 7: mod_base = OTHER; note = 2'-methoxyethylribose thymidine phosphorothioate
  modified_base 8: mod_base = OTHER; note = 2'-methoxyethylribose guanosine phosphorothioate
  modified_base 9: mod_base = OTHER; note = 2'-methoxyethylribose guanosine phosphorothioate
  modified_base 10: mod_base = OTHER; note = 2'-methoxyethylribose adenosine phosphorothioate
  modified_base 11: mod_base = OTHER; note = 2'-methoxyethylribose adenosine phosphorothioate
  modified_base 12: mod_base = OTHER; note = 2'-methoxyethylribose guanosine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
  modified_base 15: mod_base = OTHER; note = 2'-methoxyethylribose guanosine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
ggtgagtggaagtggcatgg

SEQ ID NO: 1245 - DNA, 12 bp, synthetic construct
  source 1..12: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose guanosine phosphorothioate
tcattcatctgt

SEQ ID NO: 1246 - DNA, 12 bp, synthetic construct
  source 1..12: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
ctcattcatctg

SEQ ID NO: 1247 - DNA, 12 bp, synthetic construct
  source 1..12: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
actcattcatct

SEQ ID NO: 1248 - DNA, 12 bp, synthetic construct
  source 1..12: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
cactcattcatc

SEQ ID NO: 1249 - DNA, 12 bp, synthetic construct
  source 1..12: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
tcactcattcat

SEQ ID NO: 1250 - DNA, 12 bp, synthetic construct
  source 1..12: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
atcactcattca

SEQ ID NO: 1251 - DNA, 12 bp, synthetic construct
  source 1..12: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
catcactcattc

SEQ ID NO: 1252 - DNA, 12 bp, synthetic construct
  source 1..12: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
tcatcactcatt

SEQ ID NO: 1253 - DNA, 12 bp, synthetic construct
  source 1..12: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
ctcatcactcat

SEQ ID NO: 1254 - DNA, 15 bp, synthetic construct
  source 1..15: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose thymidine phosphorothioate
  modified_base 14: mod_base = OTHER; note = 2'-methoxyethylribose guanosine phosphorothioate
cactcattcatctgt

SEQ ID NO: 1255 - DNA, 15 bp, synthetic construct
  source 1..15: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
tcactcattcatctg

SEQ ID NO: 1256 - DNA, 15 bp, synthetic construct
  source 1..15: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
atcactcattcatct

SEQ ID NO: 1257 - DNA, 15 bp, synthetic construct
  source 1..15: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
catcactcattcatc

SEQ ID NO: 1258 - DNA, 15 bp, synthetic construct
  source 1..15: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
tcatcactcattcat

SEQ ID NO: 1259 - DNA, 15 bp, synthetic construct
  source 1..15: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
ctcatcactcattca

SEQ ID NO: 1260 - DNA, 16 bp, synthetic construct
  source 1..16: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose thymidine phosphorothioate
  modified_base 15: mod_base = OTHER; note = 2'-methoxyethylribose guanosine phosphorothioate
tcactcattcatctgt

SEQ ID NO: 1261 - DNA, 16 bp, synthetic construct
  source 1..16: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
atcactcattcatctg

SEQ ID NO: 1262 - DNA, 16 bp, synthetic construct
  source 1..16: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
catcactcattcatct

SEQ ID NO: 1263 - DNA, 16 bp, synthetic construct
  source 1..16: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
tcatcactcattcatc

SEQ ID NO: 1264 - DNA, 16 bp, synthetic construct
  source 1..16: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
ctcatcactcattcat

SEQ ID NO: 1265 - DNA, 17 bp, synthetic construct
  source 1..17: mol_type = other DNA
  modified_base 1: mod_base = OTHER; note = 2'-methoxyethylribose adenosine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose cytidine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose thymidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose thymidine phosphorothioate
  modified_base 16: mod_base = OTHER; note = 2'-methoxyethylribose guanosine phosphorothioate
atcactcattcatctgt

SEQ ID NO: 1266 - DNA, 17 bp, synthetic construct
  source 1..17: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
catcactcattcatctg

SEQ ID NO: 1267 - DNA, 17 bp, synthetic construct
  source 1..17: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
tcatcactcattcatct

SEQ ID NO: 1268 - DNA, 17 bp, synthetic construct
  source 1..17: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
ctcatcactcattcatc

SEQ ID NO: 1269 - DNA, 18 bp, synthetic construct
  source 1..18: mol_type = other DNA
  modified_base 1: mod_base = OTHER; note = 2'-methoxyethylribose cytidine phosphorothioate
  modified_base 2: mod_base = OTHER; note = 2'-methoxyethylribose adenosine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose cytidine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose thymidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose thymidine phosphorothioate
  modified_base 17: mod_base = OTHER; note = 2'-methoxyethylribose guanosine phosphorothioate
catcactcattcatctgt

SEQ ID NO: 1270 - DNA, 18 bp, synthetic construct
  source 1..18: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
tcatcactcattcatctg

SEQ ID NO: 1271 - DNA, 18 bp, synthetic construct
  source 1..18: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
ctcatcactcattcatct

SEQ ID NO: 1272 - DNA, 19 bp, synthetic construct
  source 1..19: mol_type = other DNA
  modified_base 1: mod_base = OTHER; note = 2'-methoxyethylribose thymidine phosphorothioate
  modified_base 2: mod_base = OTHER; note = 2'-methoxyethylribose cytidine phosphorothioate
  modified_base 3: mod_base = OTHER; note = 2'-methoxyethylribose adenosine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose cytidine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose thymidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose thymidine phosphorothioate
  modified_base 18: mod_base = OTHER; note = 2'-methoxyethylribose guanosine phosphorothioate
tcatcactcattcatctgt

SEQ ID NO: 1273 - DNA, 19 bp, synthetic construct
  source 1..19: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
ctcatcactcattcatctg

SEQ ID NO: 1274 - DNA, 21 bp, synthetic construct
  source 1..21: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
  modified_base 20: mod_base = OTHER; note = 2'-methoxyethylribose thymidine phosphorothioate
ctcatcactcattcatctgtt

SEQ ID NO: 1275 - DNA, 21 bp, synthetic construct
  source 1..21: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
  modified_base 20: mod_base = OTHER; note = 2'-methoxyethylribose guanosine phosphorothioate
actcatcactcattcatctgt

SEQ ID NO: 1276 - DNA, 22 bp, synthetic construct
  source 1..22: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
  modified_base 20: mod_base = OTHER; note = 2'-methoxyethylribose thymidine phosphorothioate
  modified_base 21: mod_base = OTHER; note = 2'-methoxyethylribose thymidine phosphorothioate
ctcatcactcattcatctgttc

SEQ ID NO: 1277 - DNA, 22 bp, synthetic construct
  source 1..22: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
  modified_base 20: mod_base = OTHER; note = 2'-methoxyethylribose guanosine phosphorothioate
  modified_base 21: mod_base = OTHER; note = 2'-methoxyethylribose thymidine phosphorothioate
actcatcactcattcatctgtt

SEQ ID NO: 1278 - DNA, 22 bp, synthetic construct
  source 1..22: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
  modified_base 20: mod_base = OTHER; note = 2'-methoxyethylribose thymidine phosphorothioate
  modified_base 21: mod_base = OTHER; note = 2'-methoxyethylribose guanosine phosphorothioate
tactcatcactcattcatctgt

SEQ ID NO: 1279 - DNA, 23 bp, synthetic construct
  source 1..23: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose cytidine phosphorothioate
  modified_base 4: mod_base = OTHER; note = 2'-methoxyethylribose adenosine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose cytidine phosphorothioate
  modified_base 9: mod_base = OTHER; note = 2'-methoxyethylribose thymidine phosphorothioate
  modified_base 10: mod_base = OTHER; note = 2'-methoxyethylribose cytidine phosphorothioate
  modified_base 11: mod_base = OTHER; note = 2'-methoxyethylribose adenosine phosphorothioate
  modified_base 12: mod_base = OTHER; note = 2'-methoxyethylribose thymidine phosphorothioate
  modified_base 13: mod_base = OTHER; note = 2'-methoxyethylribose thymidine phosphorothioate
  modified_base 14: mod_base = OTHER; note = 2'-methoxyethylribose cytidine phosphorothioate
  modified_base 15: mod_base = OTHER; note = 2'-methoxyethylribose adenosine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose thymidine phosphorothioate
  modified_base 19: mod_base = OTHER; note = 2'-methoxyethylribose guanosine phosphorothioate
  modified_base 20: mod_base = OTHER; note = 2'-methoxyethylribose thymidine phosphorothioate
  modified_base 21: mod_base = OTHER; note = 2'-methoxyethylribose thymidine phosphorothioate
  modified_base 22: mod_base = OTHER; note = 2'-methoxyethylribose cytidine phosphorothioate
ctcatcactcattcatctgttca

SEQ ID NO: 1280 - DNA, 23 bp, synthetic construct
  source 1..23: mol_type = other DNA
  modified_base 1: mod_base = OTHER; note = 2'-methoxyethylribose adenosine phosphorothioate
  modified_base 2: mod_base = OTHER; note = 2'-methoxyethylribose cytidine phosphorothioate
  modified_base 3: mod_base = OTHER; note = 2'-methoxyethylribose thymidine phosphorothioate
  modified_base 4: mod_base = OTHER; note = 2'-methoxyethylribose cytidine phosphorothioate
  modified_base 5: mod_base = OTHER; note = 2'-methoxyethylribose adenosine phosphorothioate
  modified_base 6: mod_base = OTHER; note = 2'-methoxyethylribose thymidine phosphorothioate
  modified_base 7: mod_base = OTHER; note = 2'-methoxyethylribose cytidine phosphorothioate
  modified_base 8: mod_base = OTHER; note = 2'-methoxyethylribose adenosine phosphorothioate
  modified_base 9: mod_base = OTHER; note = 2'-methoxyethylribose cytidine phosphorothioate
  modified_base 10: mod_base = OTHER; note = 2'-methoxyethylribose thymidine phosphorothioate
  modified_base 11: mod_base = OTHER; note = 2'-methoxyethylribose cytidine phosphorothioate
  modified_base 12: mod_base = OTHER; note = 2'-methoxyethylribose adenosine phosphorothioate
  modified_base 13: mod_base = OTHER; note = 2'-methoxyethylribose thymidine phosphorothioate
  modified_base 14: mod_base = OTHER; note = 2'-methoxyethylribose thymidine phosphorothioate
  modified_base 15: mod_base = OTHER; note = 2'-methoxyethylribose cytidine phosphorothioate
  modified_base 16: mod_base = OTHER; note = 2'-methoxyethylribose adenosine phosphorothioate
  modified_base 17: mod_base = OTHER; note = 2'-methoxyethylribose thymidine phosphorothioate
  modified_base 18: mod_base = OTHER; note = 2'-methoxyethylribose cytidine phosphorothioate
  modified_base 19: mod_base = OTHER; note = 2'-methoxyethylribose thymidine phosphorothioate
  modified_base 20: mod_base = OTHER; note = 2'-methoxyethylribose guanosine phosphorothioate
  modified_base 21: mod_base = OTHER; note = 2'-methoxyethylribose thymidine phosphorothioate
  modified_base 22: mod_base = OTHER; note = 2'-methoxyethylribose thymidine phosphorothioate
actcatcactcattcatctgttc

SEQ ID NO: 1281 - DNA, 23 bp, synthetic construct
  source 1..23: mol_type = other DNA
  modified_base 1: mod_base = OTHER; note = 2'-methoxyethylribose thymidine phosphorothioate
  modified_base 2: mod_base = OTHER; note = 2'-methoxyethylribose adenosine phosphorothioate
  modified_base 3: mod_base = OTHER; note = 2'-methoxyethylribose cytidine phosphorothioate
  modified_base 4: mod_base = OTHER; note = 2'-methoxyethylribose thymidine phosphorothioate
  modified_base 5: mod_base = OTHER; note = 2'-methoxyethylribose cytidine phosphorothioate
  modified_base 6: mod_base = OTHER; note = 2'-methoxyethylribose adenosine phosphorothioate
  modified_base 7: mod_base = OTHER; note = 2'-methoxyethylribose thymidine phosphorothioate
  modified_base 8: mod_base = OTHER; note = 2'-methoxyethylribose cytidine phosphorothioate
  modified_base 9: mod_base = OTHER; note = 2'-methoxyethylribose adenosine phosphorothioate
  modified_base 10: mod_base = OTHER; note = 2'-methoxyethylribose cytidine phosphorothioate
  modified_base 11: mod_base = OTHER; note = 2'-methoxyethylribose thymidine phosphorothioate
  modified_base 12: mod_base = OTHER; note = 2'-methoxyethylribose cytidine phosphorothioate
  modified_base 13: mod_base = OTHER; note = 2'-methoxyethylribose adenosine phosphorothioate
  modified_base 14: mod_base = OTHER; note = 2'-methoxyethylribose thymidine phosphorothioate
  modified_base 15: mod_base = OTHER; note = 2'-methoxyethylribose thymidine phosphorothioate
  modified_base 16: mod_base = OTHER; note = 2'-methoxyethylribose cytidine phosphorothioate
  modified_base 17: mod_base = OTHER; note = 2'-methoxyethylribose adenosine phosphorothioate
  modified_base 18: mod_base = OTHER; note = 2'-methoxyethylribose thymidine phosphorothioate
  modified_base 19: mod_base = OTHER; note = 2'-methoxyethylribose cytidine phosphorothioate
  modified_base 20: mod_base = OTHER; note = 2'-methoxyethylribose thymidine phosphorothioate
  modified_base 21: mod_base = OTHER; note = 2'-methoxyethylribose guanosine phosphorothioate
  modified_base 22: mod_base = OTHER; note = 2'-methoxyethylribose thymidine phosphorothioate
tactcatcactcattcatctgtt

SEQ ID NO: 1282 - DNA, 23 bp, synthetic construct
  source 1..23: mol_type = other DNA
  modified_base 1: mod_base = OTHER; note = 2'-methoxyethylribose cytidine phosphorothioate
  modified_base 2: mod_base = OTHER; note = 2'-methoxyethylribose thymidine phosphorothioate
  modified_base 3: mod_base = OTHER; note = 2'-methoxyethylribose adenosine phosphorothioate
  modified_base 4: mod_base = OTHER; note = 2'-methoxyethylribose cytidine phosphorothioate
  modified_base 5: mod_base = OTHER; note = 2'-methoxyethylribose thymidine phosphorothioate
  modified_base 6: mod_base = OTHER; note = 2'-methoxyethylribose cytidine phosphorothioate
  modified_base 7: mod_base = OTHER; note = 2'-methoxyethylribose adenosine phosphorothioate
  modified_base 8: mod_base = OTHER; note = 2'-methoxyethylribose thymidine phosphorothioate
  modified_base 9: mod_base = OTHER; note = 2'-methoxyethylribose cytidine phosphorothioate
  modified_base 10: mod_base = OTHER; note = 2'-methoxyethylribose adenosine phosphorothioate
  modified_base 11: mod_base = OTHER; note = 2'-methoxyethylribose cytidine phosphorothioate
  modified_base 12: mod_base = OTHER; note = 2'-methoxyethylribose thymidine phosphorothioate
  modified_base 13: mod_base = OTHER; note = 2'-methoxyethylribose cytidine phosphorothioate
  modified_base 14: mod_base = OTHER; note = 2'-methoxyethylribose adenosine phosphorothioate
  modified_base 15: mod_base = OTHER; note = 2'-methoxyethylribose thymidine phosphorothioate
  modified_base 16: mod_base = OTHER; note = 2'-methoxyethylribose thymidine phosphorothioate
  modified_base 17: mod_base = OTHER; note = 2'-methoxyethylribose cytidine phosphorothioate
  modified_base 18: mod_base = OTHER; note = 2'-methoxyethylribose adenosine phosphorothioate
  modified_base 19: mod_base = OTHER; note = 2'-methoxyethylribose thymidine phosphorothioate
  modified_base 20: mod_base = OTHER; note = 2'-methoxyethylribose cytidine phosphorothioate
  modified_base 21: mod_base = OTHER; note = 2'-methoxyethylribose thymidine phosphorothioate
  modified_base 22: mod_base = OTHER; note = 2'-methoxyethylribose guanosine phosphorothioate
ctactcatcactcattcatctgt

SEQ ID NO: 1283 - RNA, 1288 nt, synthetic construct
  source 1..1288: mol_type = other RNA
gtgagggtcattgctcggcccctcccatgccacttccactcaccattcctgcctgcccagctcttcctctttctggccacaccatccacactctcctggccctctgagactgcccgccatgccattccctttacctggaaaactcctccctatccatcaaagtccagattcagggtcacctcctctgggaagcccaccttggcctccaggttgactctcactactcatcatcaggttcttccttctattccagccctaaccactcaggattgggccgtttgtgtctgggtatgtctcttccagctgcctgggtttcctggaaagaactcttatccccaggaactagtttgttgaataaatgctggtgaatgaatgaatgattgaacagatgaatgagtgatgagtagataaaaggatggatggagagatgggtgagtacatggatggatagatggatgagttggtgggtagattcgtggctagatggatgatggatggatggacagatggatggatatatgattgaactattgaaagtatagatgtatggatgggtgaatttgggggtaattgttagatgatggatgagtatagatgaatgatggatggataacttgatgagtggatagatagattgctggatagatgattgactgggtggatagatgaaatgttggatgagcagattaagttgtattggatgggatggatggaagtgtggttgagttattagaaggaagattgagtagataggtgaatttgttgatagtcagatgggtagataggtagatggatggatggatggatggatgtataggcagatggacaaatggatgaatgggtgggtggatgaatggaaggatgtgtggttgaactattgcaagtattgataattgggttcataatttctgaatatttagatggatggttgtgagtggctggtggacagacgaaaaatggatggttggataaattgatgggtggatggatggttggttgtatgaaagaatgaatgattgggtaggtggattaagttgcggatcaatgtatgggatggatgaatggatggatggatggatgtgtggttgaattactgaaaggttggaagagtggatgggtgaaatttggggtagttagatgggtgggtgtgtggatggataaaagagtagatgaatgaattaatgaataaacaggcagatggatgatgtaagctgccccagaccctgggacctctgacccccggcgaccccttgcactctccatgacactttctctcccatggtggcag

The invention claimed is:

1. A single stranded antisense oligonucleotide that suppresses the expression of a cryptic exon in UNC13A, wherein the entire nucleobase sequence of the antisense oligonucleotide is SEQ ID NO: 630, wherein at least one nucleoside of the antisense oligonucleotide comprises a modified sugar moiety.

2. The antisense oligonucleotide of claim 1, wherein at least one internucleoside linkage is a modified internucleoside linkage.

3. The antisense oligonucleotide of claim 2, wherein at least one modified internucleoside linkage is a phosphorothioate internucleoside linkage.

4. The antisense oligonucleotide of claim 2, wherein each modified internucleoside linkage is a phosphorothioate internucleoside linkage.

5. The antisense oligonucleotide of claim 1, wherein at least one nucleoside comprises a modified nucleobase.

6. The antisense oligonucleotide of claim 1, wherein the modified sugar moiety comprises a 2'-O-methoxyethyl group.

7. The antisense oligonucleotide of claim 1, wherein each nucleoside of the antisense oligonucleotide comprises a modified sugar moiety having a 2'-O-methoxyethyl group and each internucleoside linkage is a phosphorothioate internucleoside linkage.

8. A pharmaceutical composition comprising the antisense oligonucleotide of claim 1, and a pharmaceutically acceptable carrier, diluent and/or excipient.

9. The pharmaceutical composition of claim 8, wherein the pharmaceutical composition is suitable for parenteral delivery.

10. The pharmaceutical composition of claim 8, wherein the pharmaceutical composition is suitable for intracerebroventricular or intrathecal administration.

11. A single stranded antisense oligonucleotide that suppresses the expression of a cryptic exon in UNC13A, wherein the entire nucleobase sequence of the antisense oligonucleotide is SEQ ID NO: 55, wherein at least one nucleoside of the antisense oligonucleotide comprises a modified sugar moiety.

12. The antisense oligonucleotide of claim 11, wherein at least one internucleoside linkage is a modified internucleoside linkage.

13. The antisense oligonucleotide of claim 12, wherein at least one modified internucleoside linkage is a phosphorothioate internucleoside linkage.

14. The antisense oligonucleotide of claim 12, wherein each modified internucleoside linkage is a phosphorothioate internucleoside linkage.

15. The antisense oligonucleotide of claim 11, wherein at least one nucleoside comprises a modified nucleobase.

16. The antisense oligonucleotide of claim 11, wherein the modified sugar moiety comprises a 2'-O-methoxyethyl group.

17. The antisense oligonucleotide of claim 11, wherein each nucleoside of the antisense oligonucleotide comprises a modified sugar moiety having a 2'-O-methoxyethyl group and each internucleoside linkage is a phosphorothioate internucleoside linkage.

18. A pharmaceutical composition comprising the antisense oligonucleotide of claim 11, and a pharmaceutically acceptable carrier, diluent and/or excipient.

19. The pharmaceutical composition of claim 18, wherein the pharmaceutical composition is suitable for parenteral delivery.

20. The pharmaceutical composition of claim 18, wherein the pharmaceutical composition is suitable for intracerebroventricular or intrathecal administration.

* * * * *